(12) United States Patent
Singbartl et al.

(10) Patent No.: US 9,551,720 B2
(45) Date of Patent: Jan. 24, 2017

(54) URINE BIOMARKERS FOR PREDICTION OF RECOVERY AFTER ACUTE KIDNEY INJURY: PROTEOMICS

(75) Inventors: Kai Singbartl, Hummelstown, PA (US); John A. Kellum, Jr., Pittsburg, PA (US)

(73) Assignee: University of Pittsburgh—Of the Commonwaelth System of Higher Education, Pittsburgh, PA (US)

( * ) Notice: Subject to any disclaimer, the term of this patent is extended or adjusted under 35 U.S.C. 154(b) by 0 days.

(21) Appl. No.: 13/981,747

(22) PCT Filed: Jan. 20, 2012

(86) PCT No.: PCT/US2012/022028
§ 371 (c)(1),
(2), (4) Date: Aug. 14, 2013

(87) PCT Pub. No.: WO2012/102963
PCT Pub. Date: Aug. 2, 2012

(65) Prior Publication Data
US 2013/0323751 A1    Dec. 5, 2013

Related U.S. Application Data

(60) Provisional application No. 61/436,364, filed on Jan. 26, 2011.

(51) Int. Cl.
*G01N 33/68* (2006.01)

(52) U.S. Cl.
CPC ..... *G01N 33/6893* (2013.01); *G01N 2800/347* (2013.01); *G01N 2800/52* (2013.01); *G01N 2800/60* (2013.01)

(58) Field of Classification Search
None
See application file for complete search history.

(56) References Cited

U.S. PATENT DOCUMENTS

| | | | |
|---|---|---|---|
| 5,480,792 A | 1/1996 | Buechler et al. | 435/6.16 |
| 5,525,524 A | 6/1996 | Buechler et al. | 436/518 |
| 5,571,698 A | 11/1996 | Ladner et al. | 435/69.7 |
| 5,631,171 A | 5/1997 | Sandstrom et al. | 436/518 |
| 5,679,526 A | 10/1997 | Buechler et al. | 435/7.1 |
| 5,824,799 A | 10/1998 | Buechler et al. | 540/128 |
| 5,851,776 A | 12/1998 | Valkirs | 435/7.1 |
| 5,885,527 A | 3/1999 | Buechler | 422/412 |
| 5,922,615 A | 7/1999 | Nowakowski et al. | 436/518 |
| 5,939,272 A | 8/1999 | Buechler et al. | 435/7.1 |
| 5,947,124 A | 9/1999 | Buechler et al. | 128/898 |
| 5,955,377 A | 9/1999 | Maul et al. | 436/518 |
| 5,985,579 A | 11/1999 | Buechler et al. | 435/7.1 |
| 6,019,944 A | 2/2000 | Buechler | 422/412 |
| 6,057,098 A | 5/2000 | Buechler et al. | 506/18 |
| 6,113,855 A | 9/2000 | Buechler | 422/412 |
| 6,143,576 A | 11/2000 | Buechler | 436/518 |
| 2007/0154897 A1* | 7/2007 | Yen et al. | 435/6 |

FOREIGN PATENT DOCUMENTS

| | | | |
|---|---|---|---|
| WO | WO 2010/036342 A2 | | 4/2010 |
| WO | WO 2010/048346 | * | 4/2010 |
| WO | WO 2011/025917 A1 | | 3/2011 |
| WO | WO 2011/057147 | * | 5/2011 |

OTHER PUBLICATIONS

Ali, et al., "Incidence and outcomes in acute kidney injury: a comprehensive population-based study." *J Am Soc Nephrol*, 18(4):1292-1298 (2007).

Augustine, et al., "A randomized controlled trial comparing intermittent with continuous dialysis in patients with ARF." *Am J Kidney Dis*, 44(6):1000-1007 (2004).

Bagshaw, et al., "A multi-centre evaluation of the RIFLE criteria for early acute kidney injury in critically ill patients." *Nephrol Dial Transplant*, 23(4):1203-1210 (2008).

Bellomo, et al., "Acute Renal Failure—Definition, Outcome Measures, Animal Models, Fluid Therapy and Information Technology Needs: The Second International Consensus Conference of the Acute Dialysis Quality Initiative (ADQI) Group." *Crit Care*, 8(4):R204-212 (2004).

Bhandari and Turney, "Survivors of acute renal failure who do not recover renal function." *QJM*, 89(6):415-421 (1996).

Charlson, et al., "A new method of classifying prognostic comorbidity in longitudinal studies: development and validation." *J Chronic Dis*, 40(5):373-383 (1987).

Chertow, et al., "Acute kidney injury, mortality, length of stay, and costs in hospitalized patients." *J Am Soc Nephrol*, 16(11):3365-3370 (2005).

Coca, et al., "Biomarkers for the diagnosis and risk stratification of acute kidney injury: a systematic review." *Kidney Int*, 73(9):1008-1016 (2008).

Cwirla, et al., "Peptides on phage: a vast library of peptides for identifying ligands." *Proc Natl Acad Sci U S A*, 87(16):6378-6382 (1990).

Devlin, et al., "Random peptide libraries: a source of specific protein binding molecules." *Science*, 249(4967):404-406 (1990).

Fischer, et al., "A readers' guide to the interpretation of diagnostic test properties: clinical example of sepsis." *Intensive Care Med*, 29(7):1043-1051 (2003).

"Gastrointestinal Disorders." in *The Merck Manual of Diagnosis and Therapy* (Beers, et al., Eds.) 17th ed., pp. 221-342, Merck (1999).

(Continued)

*Primary Examiner* — Suzanne M Noakes
(74) *Attorney, Agent, or Firm* — Medlen & Carroll, LLP

(57) ABSTRACT

This invention is related to the field of the prevention and treatment of kidney disease. The treatment of kidney disease may be tailored depending upon the need for, or expectation of, renal recovery. For example, renal recovery can be determined by monitoring urine biomarkers related to the development of chronic kidney disease. For example, a normalized time course of approximately fourteen Days measuring urinary proteins can be used to establish the risk of recovery versus non-recovery in patient's having suffered an acute kidney injury. Alternatively, the invention describes signature protein expression profiles to establish the probability of renal recovery and/or renal non-recovery.

8 Claims, 7 Drawing Sheets

(56) References Cited

OTHER PUBLICATIONS

George and Neilson, "Disorders of the Kidney and Urinary Tract." in *Harrison's Principles of Internal Medicine, 17th Edition* (Fauci, et al., Eds.) 17th ed., pp. 1741-1830, (pp. 1741-1753) McGraw-Hill Medical, New York (2008a).
George and Neilson, "Disorders of the Kidney and Urinary Tract." in *Harrison's Principles of Internal Medicine, 17th Edition* (Fauci, et al., Eds.) 17th ed., pp. 1741-1830, (pp. 1754-1766) McGraw-Hill Medical, New York (2008b).
George and Neilson, "Disorders of the Kidney and Urinary Tract." in *Harrison's Principles of Internal Medicine, 17th Edition* (Fauci, et al., Eds.) 17th ed., pp. 1741-1830, (pp. 1767-1778) McGraw-Hill Medical, New York (2008c).
George and Neilson, "Disorders of the Kidney and Urinary Tract." in *Harrison's Principles of Internal Medicine, 17th Edition* (Fauci, et al., Eds.) 17th ed., pp. 1741-1830, (pp. 1779-1791) McGraw-Hill Medical, New York (2008d).
George and Neilson, "Disorders of the Kidney and Urinary Tract." in *Harrison's Principles of Internal Medicine, 17th Edition* (Fauci, et al., Eds.) 17th ed., pp. 1741-1830, (pp. 1792-1804) McGraw-Hill Medical, New York (2008e).
George and Neilson, "Disorders of the Kidney and Urinary Tract." in *Harrison's Principles of Internal Medicine, 17th Edition* (Fauci, et al., Eds.) 17th ed., pp. 1741-1830, (pp. 1805-1817) McGraw-Hill Medical, New York (2008f).
George and Neilson, "Disorders of the Kidney and Urinary Tract." in *Harrison's Principles of Internal Medicine, 17th Edition* (Fauci, et al., Eds.) 17th ed., pp. 1741-1830, (pp. 1818-1830) McGraw-Hill Medical, New York (2008g).
Herget-Rosenthal, et al., "Measurement of urinary cystatin C by particle-enhanced nephelometric immunoassay: precision, interferences, stability and reference range." *Ann Clin Biochem*, 41(Pt 2):111-118 (2004).
Hirsch, et al., "NGAL is an early predictive biomarker of contrast-induced nephropathy in children." *Pediatr Nephrol*, 22(12):2089-2095 (2007).
Kellum, "Acute kidney injury." *Crit Care Med*, 36(4 Suppl):S141-145 (2008).
Knaus, et al., "The Apache III prognostic system. Risk prediction of hospital mortality for critically ill hospitalized adults." *Chest*, 100(6):1619-1636 (1991).
Lassnigg, et al., "Minimal changes of serum creatinine predict prognosis in patients after cardiothoracic surgery: a prospective cohort study." *J Am Soc Nephrol*, 15(6):1597-1605 (2004).
Levy, et al., "2001 SCCM/ESICM/ACCP/ATS/SIS International Sepsis Definitions Conference." *Crit Care Med*, 31(4):1250-1256 (2003).
Liu and Yang, "Hepatocyte growth factor: new arsenal in the fights against renal fibrosis?" *Kidney Int*, 70(2):238-240 (2006).
Manns, et al., "Cost of acute renal failure requiring dialysis in the intensive care unit: clinical and resource implications of renal recovery." *Crit Care Med*, 31(2):449-455 (2003).
McCullough, et al., "Contrast-Induced Nephropathy (CIN) Consensus Working Panel: executive summary." *Rev Cardiovasc Med*, 7(4):177-197 (2006).
Mehta, et al., "A randomized clinical trial of continuous versus intermittent dialysis for acute renal failure." *Kidney Int*, 60(3):1154-1163 (2001).
Mehta, et al., "Acute Kidney Injury Network: report of an initiative to improve outcomes in acute kidney injury." *Crit Care*, 11(2):R31 (2007).
Mishra, et al., "Kidney NGAL is a novel early marker of acute injury following transplantation." *Pediatr Nephrol*, 21(6):856-863 (2006).
Nelson and Griswold, "A computer program for calculating antibody affinity constants." *Comput Methods Programs Biomed*, 27(1):65-68 (1988).
Palevsky, et al., "Intensity of renal support in critically ill patients with acute kidney injury." *N Engl J Med*, 359(1):7-20 (2008).
Parikh, et al., "Urine IL-18 is an early diagnostic marker for acute kidney injury and predicts mortality in the intensive care unit." *J Am Soc Nephrol*, 16(10):3046-3052 (2005).
Parikh, et al., "Urinary IL-18 is an early predictive biomarker of acute kidney injury after cardiac surgery." *Kidney Int*, 70(1):199-203 (2006).
Pecoits-Filho, et al., "Associations between circulating inflammatory markers and residual renal function in CRF patients." *Am J Kidney Dis*, 41(6):1212-1218 (2003).
Praught and Shlipak, "Are small changes in serum creatinine an important risk factor?" *Curr Opin Nephrol Hypertens*, 14(3):265-270 (2005).
Ricci, et al., "The RIFLE criteria and mortality in acute kidney injury: A systematic review." *Kidney Int*, 73(5):538-546 (2008).
Ronco, et al., "Matrix metalloproteinases in kidney disease progression and repair: a case of flipping the coin." *Semin Nephrol*, 27(3):352-362 (2007).
Scott and Smith, "Searching for peptide ligands with an epitope library." *Science*, 249(4967):386-390 (1990).
Supavekin, et al., "Differential gene expression following early renal ischemia/reperfusion." *Kidney Int*, 63(5):1714-1724 (2003).
Thakar, et al., "A clinical score to predict acute renal failure after cardiac surgery." *J Am Soc Nephrol*, 16(1):162-168 (2005).
Uchino, et al., "Acute renal failure in critically ill patients: a multinational, multicenter study." *JAMA*, 294(7):813-818 (2005).
Uchino, et al., "Discontinuation of continuous renal replacement therapy: a post hoc analysis of a prospective multicenter observational study." *Crit Care Med*, 37(9):2576-2582 (2009).
Uehlinger, et al., "Comparison of continuous and intermittent renal replacement therapy for acute renal failure." *Nephrol Dial Transplant*, 20(8):1630-1637 (2005).
van Erp, et al., "Application of a sol particle immunoassay to the determination of affinity constants of monoclonal antibodies." *J Immunoassay*, 12(3):425-443 (1991).
Vincent, et al., "The SOFA (Sepsis-related Organ Failure Assessment) score to describe organ dysfunction/failure. On behalf of the Working Group on Sepsis-Related Problems of the European Society of Intensive Care Medicine." *Intensive Care Med*, 22(7):707-710 (1996).
Ward, et al., "Binding activities of a repertoire of single immunoglobulin variable domains secreted from *Escherichia coli.*" *Nature*, 341(6242):544-546 (1989).
Watrick and Morrison, "Kidney Disease." in *Current Medical Diagnosis and Treatment 2008* (McPhee, et al., Eds.) 47 ed., pp. 785-815 (2008a).
Watrick and Morrison, "Kidney Disease." in *Current Medical Diagnosis and Treatment 2008* (McPhee, et al., Eds.) 47 ed., pp. 785-815 (2008b).
Wilson, et al., "Simplified conjugation chemistry for coupling peptides to F(ab') fragments: autologous red cell agglutination assay for HIV-1 antibodies." *J Immunol Methods*, 175(2):267-273 (1994).
Yarmush, et al., "Coupling of antibody-binding fragments to solid-phase supports: site-directed binding of F(ab')2 fragments." *J Biochem Biophys Methods*, 25(4):285-297 (1992).
Zappitelli, et al., "Urine neutrophil gelatinase-associated lipocalin is an early marker of acute kidney injury in critically ill children: a prospective cohort study." *Crit Care*, 11(4):R84 (2007).
ISR PCT US2012/022028.
Kwon, et al., "Simultaneous monitoring of multiple urinary cytokines may predict renal and patient outcome in ischemic AKI." *Ren Fail*, 32(6):699-708 (2010).
Kitamura, et al., "IL-6-STAT3 controls intracellular MHC class II alphabeta dimer level through cathepsin S activity in dendritic cells." *Immunity*, 23(5):491-502 (2005).
Koyner, et al., "Urinary cystatin C as an early biomarker of acute kidney injury following adult cardiothoracic surgery." *Kidney Int*, 8:1059-1069 (2008).
Matsumoto, et al., "Hepatocyte growth factor in renal regeneration, renal disease and potential therapeutics." *Curr Opin Nephrol Hypertens*, 9(4):395-402 (2000).

(56) References Cited

OTHER PUBLICATIONS

Nejat, et al., "Urinary cystatin C is diagnostic of acute kidney injury and sepsis, and predicts mortality in the intensive care unit." *Crit Care*, 14(3):R85 (2010).
Pencina, et al., "Evaluating the added predictive ability of a new marker: from area under the ROC curve to reclassification and beyond." *Stat Med*, 27(2):157-172; discussion 207-112 (2008).
Stevens, et al., "Factors other than glomerular filtration rate affect serum cystatin C levels." *Kidney Int*, 75(6):652-660 (2009).
Taman, et al., "Increase urinary hepatocyte growth factor excretion in human acute renal failure." *Clin Nephrol*, 48(4):241-245 (1997).
Uchida and Gotoh, "Measurement of cystatin-C and creatinine in urine." *Clin Chim Acta*, 323(1-2):121-128 (2002).
Vijayan, et al., "Hepatocyte growth factor inhibits apoptosis after ischemic renal injury in rats." *Am J Kidney Dis*, 38(2):274-278 (2001).

\* cited by examiner

| Peptides | Spectra | Coverage | Protein |
|---|---|---|---|
| 1 | 2 | NaN | solute carrier family 13 member 3 isoform b [Homo sapiens]; solute carrier family 13 member 3 isoform a [Homo sa |
| 1 | 1 | 0.146 | GTPase Rab14 [Homo sapiens] |
| 1 | 1 | 0.164 | transmembrane protein 9 [Homo sapiens] |
| 1 | 1 | NaN | calcium binding protein 39 [Homo sapiens]; calcium binding protein 39 [Homo sapiens]; calcium binding protein 39 |
| 1 | 1 | 0.00284 | hemicentin 1 [Homo sapiens] |
| 1 | 1 | 0.0913 | prostate stem cell antigen preproprotein [Homo sapiens] |
| 1 | 2 | 0.0246 | solute carrier family 47, member 1 [Homo sapiens] |
| 1 | 1 | 0.0728 | biliverdin reductase B (flavin reductase (NADPH)) [Homo sapiens] |
| 1 | 1 | NaN | proteasome alpha 4 subunit isoform 1 [Homo sapiens]; proteasome alpha 4 subunit isoform 1 [Homo sapiens] |
| 1 | 1 | NaN | palate, lung and nasal epithelium associated precursor [Homo sapiens]; palate, lung and nasal epithelium associat |
| 1 | 5 | NaN | PREDICTED: similar to hCG1642536 [Homo sapiens]; PREDICTED: similar to hCG1642536 [Homo sapiens] |
| 1 | 1 | 0.0424 | actin, alpha 1, skeletal muscle [Homo sapiens] |
| 1 | 1 | 0.0656 | RAP2B, member of RAS oncogene family [Homo sapiens] |
| 1 | 8 | 0.045 | transmembrane BAX inhibitor motif containing 1 [Homo sapiens] |
| 1 | 1 | 0.0483 | mucolipin 1 [Homo sapiens] |
| 1 | 1 | 0.0343 | annexin IV [Homo sapiens] |
| 1 | 1 | NaN | diazepam binding inhibitor isoform 2 [Homo sapiens]; diazepam binding inhibitor isoform 3 [Homo sapiens]; diazep |
| 1 | 2 | 0.0335 | tubulin, alpha 4a [Homo sapiens] |
| 1 | 1 | 0.0203 | solute carrier family 1 (neutral amino acid transporter), member 5 [Homo sapiens] |
| 1 | 1 | 0.0652 | claudin 2 [Homo sapiens] |
| 1 | 1 | NaN | myoferlin isoform a [Homo sapiens]; myoferlin isoform b [Homo sapiens] |
| 1 | 1 | NaN | deleted in malignant brain tumors 1 isoform a precursor [Homo sapiens]; deleted in malignant brain tumors 1 isofor |
| 1 | 1 | 0.0234 | galactosylceramidase isoform a precursor [Homo sapiens] |
| 1 | 1 | NaN | hypothetical protein LOC55194 [Homo sapiens]; PREDICTED: hypothetical protein [Homo sapiens] |
| 1 | 3 | NaN | CD151 antigen [Homo sapiens]; CD151 antigen [Homo sapiens]; CD151 antigen [Homo sapiens]; CD151 antigen [Ho |
| 1 | 2 | 0.066 | RAB2A, member RAS oncogene family [Homo sapiens] |
| 1 | 1 | 0.0132 | actinin, alpha 4 [Homo sapiens] |
| 1 | 1 | NaN | tumor differentially expressed protein 1 [Homo sapiens]; tumor differentially expressed protein 1 [Homo sapiens] |
| 1 | 1 | NaN | phosphodiesterase 8A isoform 2 [Homo sapiens]; phosphodiesterase 8A isoform 1 [Homo sapiens] |
| 1 | 1 | 0.0112 | SH3 domain and tetratricopeptide repeats 1 [Homo sapiens] |
| 1 | 1 | NaN | BH3 interacting domain death agonist isoform 2 [Homo sapiens]; BH3 interacting domain death agonist isoform 3 [H |
| 1 | 1 | NaN | ribophorin II isoform 2 precursor [Homo sapiens] |
| 1 | 1 | 0.0657 | chromatin modifying protein 4C [Homo sapiens] |
| 1 | 1 | NaN | secsin [Homo sapiens] |
| 1 | 1 | 0.0444 | lumican precursor [Homo sapiens] |
| 1 | 1 | 0.0302 | chromatin modifying protein 1B [Homo sapiens] |
| 1 | 1 | NaN | SHC (Src homology 2 domain containing) transforming protein 1 isoform 2 [Homo sapiens]; SHC (Src homology 2 d |
| 1 | 1 | NaN | ATPase, H+ transporting, lysosomal V0 subunit e4 [Homo sapiens]; ATPase, H+ transporting, lysosomal V0 subunit |
| 1 | 1 | 0.0544 | UBX domain protein 6 [Homo sapiens] |
| 1 | 1 | 0.0192 | tetratricopeptide repeat domain 38 [Homo sapiens] |
| 1 | 2 | 0.0629 | crystallin, alpha B [Homo sapiens] |
| 1 | 1 | 0.00775 | dual oxidase 2 precursor [Homo sapiens] |
| 1 | 3 | 0.126 | DnaJ (Hsp40) homolog, subfamily C, member 5 [Homo sapiens] |
| 1 | 1 | 0.11 | secretoglobin, family 1A, member 1 (uteroglobin) [Homo sapiens] |
| 1 | 1 | NaN | structural maintenance of chromosomes 2 [Homo sapiens]; structural maintenance of chromosomes 2 [Homo sapie |
| 1 | 1 | 0.691 | superoxide dismutase 1, soluble [Homo sapiens] |
| 1 | 1 | 0.0227 | solute carrier family 44, member 2 [Homo sapiens] |
| 1 | 2 | NaN | PREDICTED: hypothetical protein [Homo sapiens] |
| 1 | 1 | 0.0403 | tropomyosin 4 [Homo sapiens] |
| 1 | 1 | 0.0101 | myosin VI [Homo sapiens] |
| 1 | 1 | 0.0176 | heat shock protein 90kDa alpha (cytosolic), class A member 1 isoform 1 [Homo sapiens] |
| 1 | 1 | NaN | RAB1A, member RAS oncogene family isoform 1 [Homo sapiens]; RAB1B, member RAS oncogene family [Homo sa |
| 1 | 2 | NaN | PREDICTED: similar to hCG1992647, partial [Homo sapiens] |
| 1 | 1 | NaN | eukaryotic translation initiation factor 5A isoform A [Homo sapiens] |
| 1 | 3 | 0.143 | PDZK1 interacting protein 1 [Homo sapiens] |
| 1 | 1 | NaN | hexosaminidase A preproprotein [Homo sapiens] |
| 1 | 1 | 0.0491 | paralemmin isoform 1 [Homo sapiens] |
| 1 | 1 | 0.00904 | zinc finger protein 252 [Homo sapiens] |
| 1 | 1 | 0.0196 | skeletal muscle receptor tyrosine kinase [Homo sapiens] |
| 1 | 1 | NaN | spastin isoform 2 [Homo sapiens]; spastin isoform 1 [Homo sapiens] |
| 1 | 2 | 0.0748 | allograft inflammatory factor 1 isoform 3 [Homo sapiens] |
| 1 | 1 | 0.0539 | quinolinate phosphoribosyltransferase [Homo sapiens] |
| 1 | 1 | NaN | transmembrane protein 105A [Homo sapiens]; PREDICTED: similar to Transmembrane protein 105A [Homo sapien |
| 1 | 1 | 0.062 | uroplakin 1A [Homo sapiens] |
| 1 | 1 | 0.075 | secretory carrier membrane protein 3 isoform 1 [Homo sapiens] |
| 1 | 1 | 0.225 | guanine nucleotide binding protein (G protein), gamma 2 [Homo sapiens] |
| 1 | 1 | 0.0476 | sorbitol dehydrogenase [Homo sapiens] |

Figure 3 (cont'd)

URINE BIOMARKERS FOR PREDICTION OF RECOVERY AFTER ACUTE KIDNEY INJURY: PROTEOMICS

STATEMENT OF GOVERNMENT SUPPORT

This invention was made with government support under grant #DK 070910 awarded by the National Institutes of Health. The government has certain rights in the invention.

FIELD OF THE INVENTION

This invention is related to the field of the prevention and treatment of kidney disease. The treatment of kidney disease may be tailored depending upon the need for, or expectation of, renal recovery. For example, prediction of renal recovery can be determined by monitoring urine biomarkers related to the development of chronic kidney disease. For example, differential expression platforms can be used to identify biomarker proteins in order to establish the risk of renal recovery versus renal non-recovery in patient's having suffered an acute kidney injury.

BACKGROUND

Acute Kidney Injury (AKI) has an estimated incidence rate of approximately 2000 per million population and this rate is increasing. Ali et al. "Incidence and outcomes in acute kidney injury: a comprehensive population-based study" J Am Soc Nephrol 18:1292-1298 (2007). Approximately 5% of all people admitted to intensive care units around the world develop severe AM requiring dialysis. Uchino et al., "Acute renal failure in critically ill patients: a multinational, multicenter study" JAMA 294:813-818 (2005). A recent, multi-center study found that fewer than only about 60% patients surviving severe AKI recovered renal function by two months. Palevsky et al., "Intensity of renal support in critically ill patients with acute kidney injury" N Engl J Med 359:7-20 (2008). Thus, a large number of patients with AKI go on to have end-stage renal disease (ESRD).

However, since only a fraction of patients with AKI fail to recover renal function, interventions aimed at improving recovery or providing renal support (e.g. early dialysis) cannot be targeted appropriately without some means of determining which patients will recover and which will not. Unfortunately, clinical risk prediction for recovery after AKI is extremely limited. Research efforts to treat AM and prevent ESRD could be tailored according to long-term-prognosis. In other words, with an accurate prediction of which patients will not recover kidney function, medical efforts could focus the development and application of aggressive treatment interventions on just these patients. Conversely, patients with a favorable prognosis would be spared from more aggressive interventions and their potential adverse effects.

Thus, development of a biomarker or biomarker panel that allows early prediction of recovery of kidney function would be an extremely valuable clinical tool. What is needed in the art are a panel of biomarkers to predict renal recovery after AKI.

SUMMARY

This invention is related to the field of the prevention and treatment of kidney disease. The treatment of kidney disease may be tailored depending upon the need for, or expectation of, renal recovery. For example, prediction of renal recovery can be determined by monitoring urine biomarkers related to the development of chronic kidney disease. For example, differential expression platforms can be used to identify biomarker proteins in order to establish the risk of renal recovery versus renal non-recovery in patient's having suffered an acute kidney injury.

In one embodiment, the present invention contemplates a composition comprising an renal injury biomarker, wherein said biomarker comprises at least a fragment of a protein selected from the group consisting of ferritin, beta globin, catalase, alpha globin, epidermal growth factor receptor pathway substrate 8, mucin isoform precursor, ezrin, delta globin, moesin, phosphoprotein isoform, annexin A2, myoglobin, hemopexin, serine proteinase inhibitor, serpine peptidase inhibitor, CD14 antigen precursor, fibronectin isoform preprotein, angiotensinogen preprotein, complement component precursor, carbonic anhydrase, uromodulin precursor, complement factor H, complement component 4 BP, heparan sulfate proteoglycan 2, olfactomedian-4, leucine rich alpha-2 glycoprotein, ring finger protein 167, inter-alpha globulin inhibitor H4, heparan sulfate proteoglycan 2, N-acylshingosine aminohydrolase, serine proteinase inhibitor clade A member 1, mucin 1, clusterin isoform 1, brain abundant membrane attached signal protein 1, dipeptidase 1, fibronectin 1 isoform 5 preprotein, angiotensinogen preproprotien, carbonic anhydrase, and uromodulin precursor. In one embodiment, the composition further comprises a urine sample. In one embodiment, the urine sample is collected between 1 day and 14 days after a kidney injury. In one embodiment, the urine sample is a human urine sample. In one embodiment, the biomarker is at least 2.5 fold higher as compared to an expected level in a renal recovery group. In one embodiment, the biomarker is at least 2.0 fold higher as compared to an expected level in a renal recovery group. In one embodiment, the biomarker is at least 1.5 fold higher as compared to an expected level in a renal recovery group. In one embodiment, the biomarker is at least 1.25 fold higher as compared to an expected level in a renal recovery group. In one embodiment, the biomarker is at least 2.5 fold lower as compared to an expected level in a renal recovery group. In one embodiment, the biomarker is at least 2.0 fold lower as compared to an expected level in a renal recovery group. In one embodiment, the biomarker is at least 1.5 fold lower as compared to an expected level in a renal recovery group. In one embodiment, the biomarker is at least 1.25 fold lower as compared to an expected level in a renal recovery group.

In one embodiment, the present invention contemplates a method, comprising: a) providing; i) a patient exhibiting at least one symptom of an acute renal injury; and ii) a biological fluid sample obtained from said patient, wherein said sample comprises a renal injury biomarker; b) measuring a renal recovery biomarker value; c) comparing said said renal biomarker value to an expected value from a renal recovery group; and d) predicting a probability of renal recovery for said patient based upon said comparison. In one embodiment, the probability of renal recovery is greater than 90%. In one embodiment, the probability of renal recovery is greater than 75%. In one embodiment, the probability of renal recovery is greater than 50%. In one embodiment, the probability of renal recovery is less than 50%. In one embodiment, the probability of renal recovery is less than 25%. In one embodiment, the probability of renal recovery is less than 10%. In one embodiment, the biomarker comprises at least a fragment of a protein selected from the group consisting of ferritin, beta globin, catalase, alpha globin, epidermal growth factor receptor pathway substrate 8, mucin isoform precursor, ezrin, delta globin, moesin, phosphoprotein isoform, annexin A2, myoglobin, hemopexin, serine proteinase inhibitor, serpine peptidase inhibitor, CD14 antigen precursor, fibronectin isoform preprotein, angiotensinogen preprotein, complement component precursor, carbonic anhydrase, uromodulin precursor, complement factor H, complement component 4 BP, heparan sulfate proteoglycan 2, olfactomedian-4, leucine rich alpha-2 glycoprotein, ring finger protein 167, inter-alpha globulin inhibitor H4, heparan sulfate proteoglycan 2, N-acylshingosine aminohydrolase, serine proteinase inhibitor Glade A member 1, mucin 1, clusterin isoform 1, brain abundant membrane attached signal protein 1, dipeptidase 1, fibronectin 1 isoform 5 preprotein, angiotensinogen preproprotien, carbonic anhydrase, and uromodulin precursor.

In one embodiment, the present invention contemplates a kit, comprising; a) a first container comprising an antibody specifically directed to an renal injury biomarker, wherein said biomarker comprises at least a fragment of a protein selected from the group consisting of ferritin, beta globin, catalase, alpha globin, epidermal growth factor receptor pathway substrate 8, mucin isoform precursor, ezrin, delta globin, moesin, phosphoprotein isoform, annexin A2, myoglobin, hemopexin, serine proteinase inhibitor, serpine peptidase inhibitor, CD14 antigen precursor, fibronectin isoform preprotein, angiotensinogen preprotein, complement component precursor, carbonic anhydrase, uromodulin precursor, complement factor H, complement component 4 BP, heparan sulfate proteoglycan 2, olfactomedian-4, leucine rich alpha-2 glycoprotein, ring finger protein 167, inter-alpha globulin inhibitor H4, heparan sulfate proteoglycan 2, N-acylshingosine aminohydrolase, serine proteinase inhibitor Glade A member 1, mucin 1, clusterin isoform 1, brain abundant membrane attached signal protein 1, dipeptidase 1, fibronectin 1 isoform 5 preprotein, angiotensinogen preproprotien, carbonic anhydrase, and uromodulin precursor; b) instructions for determining whether said biomarker is overexpressed as compared to an expected value from a renal recovery group; c) instructions for determining whether said biomarker is underexpressed as compared to an expected value from a renal recovery group; and d) instructions for determining the probability of renal recovery. In one embodiment, the antibody is a monoclonal antibody. In one embodiment, the monoclonal antibody is specifically directed to said biomarker protein fragment.

In one embodiment, the present invention contemplates a signature expression profile comprising a urinary protein biomarker panel, wherein said profile predicts renal recovery. In one embodiment, the biomarker panel comprises a plurality of overexpressed urinary proteins. In one embodiment, the biomarker panel comprises a plurality of underexpressed urinary proteins. In one embodiment, the plurality of overexpressed urinary proteins are selected from the group consisting of beta globin, catalase, alpha globin, mucin isoform precursor, ezrin, delta globin, moesin, phosphoprotein isoform, and annexin A2. In one embodiment, the plurality of underexpressed urinary proteins are selected from the group consisting of myoglobin, hemopexin, serine proteinase inhibitor, serpine peptidase inhibitor, CD14 antigen precursor, fibronectin isoform preprotein, angiotensinogen preprotein, complement component precursor, carbonic anhydrase, and uromodulin precursor.

In one embodiment, the present invention contemplates a signature expression profile comprising a urinary protein biomarker panel, wherein said profile predicts renal non-recovery. In one embodiment, the biomarker panel comprises a plurality of overexpressed urinary proteins. In one embodiment, the biomarker panel comprises a plurality of underexpressed urinary proteins. In one embodiment, the plurality of overexpressed urinary proteins are selected from the group consisting of beta globin, catalase, alpha globin, mucin isoform precursor, ezrin, delta globin, moesin, phosphoprotein isoform, and annexin A2. In one embodiment, the plurality of underexpressed urinary proteins are selected from the group consisting of myoglobin, hemopexin, serine proteinase inhibitor, serpine peptidase inhibitor, CD14 antigen precursor, fibronectin isoform preprotein, angiotensinogen preprotein, complement component precursor, carbonic anhydrase, and uromodulin precursor.

In one embodiment, the present invention contemplates a method, comprising: a) providing; i) a patient exhibiting at least one symptom of an acute renal injury; and ii) a biological fluid sample obtained from said patient, wherein said sample comprises a plurality of renal biomarker nucleic acids; b) expressing said plurality of renal biomarker nucleic acids, thereby creating a signature expression profile; and c) predicting a probability of renal recovery for said patient based upon said signature expression profile. In one embodiment, the signature expression profile predicts a probability of renal recovery of greater than 90%. In one embodiment, the signature expression profile predicts a probability of renal recovery of greater than 75%. In one embodiment, the signature expression profile predicts a probability of renal recovery of greater than 50%. In one embodiment, the signature expression profile predicts a probability of renal recovery of less than 50%. In one embodiment, the signature expression profile predicts a probability of renal recovery of less than 25%. In one embodiment, the signature expression profile predicts a probability of renal recovery of less than 10%. In one embodiment, the signature expression profile comprises a plurality of overexpressed urinary proteins. In one embodiment, the signature expression profile comprises a plurality of underexpressed urinary proteins. In one embodiment, the plurality of overexpressed urinary proteins are selected from the group consisting of beta globin, catalase, alpha globin, mucin isoform precursor, ezrin, delta globin, moesin, phosphoprotein isoform, and annexin A2. In one embodiment, the plurality of underexpressed urinary proteins are selected from the group consisting of myoglobin, hemopexin, serine proteinase inhibitor, serpine peptidase inhibitor, CD14 antigen precursor, fibronectin isoform preprotein, angiotensinogen preprotein, complement component precursor, carbonic anhydrase, and uromodulin precursor.

In one embodiment, the present invention contemplates a kit, comprising; a) a first container comprising reagents for creating a signature expression profile using a biological sample, wherein said signature expression profile comprises a plurality of renal biomarker nucleic acids; b) a second container comprising monoclonal antibodies specific for said renal biomarker nucleic acids; c) a set of instructions for creating said signature expression profile; d) a set of instructions for determining overexpressed renal biomarker nucleic acids; e) a set of instructions for determining underexpressed renal biomarker nucleic acids; f) a set of instructions for predicting the probability of renal recovery; and g) a set of instructions for predicting the probability of renal non-recovery.

DEFINITIONS

As used herein, an "injury to renal function" is an abrupt (i.e., for example, within 14 Days, preferably within 7 Days, more preferably within 72 hours, and still more preferably within 48 hours) measurable reduction in a measure of renal function. Such an injury to renal function may be identified, for example, by a decrease in glomerular filtration rate (GFR) or estimated GFR (eGFR), a reduction in urine output, an increase in serum creatinine, an increase in serum cystatin C, a requirement for renal replacement therapy (i.e., for example, dialysis), etc.

As used herein, an "improvement in renal function" is an abrupt (i.e., for example, within 14 Days, preferably within 7 Days, more preferably within 72 hours, and still more preferably within 48 hours) measurable increase in a measure of renal function. Preferred methods for measuring and/or estimating GFR are described hereinafter.

As used herein, "reduced renal function" is an abrupt (i.e., for example, within 14 Days, preferably within 7 Days, more preferably within 72 hours, and still more preferably within 48 hours) reduction in kidney function identified by an absolute increase in serum creatinine of greater than or equal to 0.1 mg/dL ($\geq$8.8 µmol/L), a percentage increase in serum creatinine of greater than or equal to 20% (1.2-fold from baseline), or a reduction in urine output (documented oliguria of less than 0.5 ml/kg per hour).

As used herein, "acute renal failure" or "ARF" is an abrupt (i.e., for example, within 14 Days, preferably within 7 Days, more preferably within 72 hours, and still more preferably within 48 hours) reduction in kidney function identified by an absolute increase in serum creatinine of greater than or equal to 0.3 mg/dl ($\geq$26.4 µmol/l), a percentage increase in serum creatinine of greater than or equal to 50% (1.5-fold from baseline), or a reduction in urine output (documented oliguria of less than 0.5 ml/kg per hour for at least 6 hours). This term is synonymous with "acute kidney injury" or "AKI."

As used herein, the term "relating a signal to the presence or amount" of an analyte refers to assay measurements using a standard curve calculated with known concentrations of the analyte of interest. The skilled artisan will understand that the signals obtained from an assay are often a direct result of complexes formed between, for example, one or more antibodies and a target biomolecule (i.e., for example, an analyte) and/or polypeptides containing an epitope(s) to which, for example, antibodies bind. While such assays may detect a full length biomarker and the assay result may be expressed as a concentration of a biomarker of interest, the signal from the assay is actually a result of all such "immunoreactive" polypeptides present in the sample.

As the term is used herein, an assay is "configured to detect" an analyte if an assay can generate a detectable signal indicative of the presence or amount of a physiologically relevant concentration of the analyte. For example, an antibody epitope is usually on the order of 8 amino acids, such that an immunoassay can be configured to detect a marker of interest that will also detect polypeptides related to the marker sequence, so long as those polypeptides contain the epitope(s) necessary to bind to the antibody or antibodies used in the assay.

The term "related marker" or "biomarker" as used herein with regard to a physiological substance such as one of the proteins as described herein. A related marker may also refer to one or more fragments, variants, etc., of a particular protein and/or peptide or its biosynthetic parent that may be detected as a surrogate for the marker itself or as independent biomarkers. The term also refers to one or more polypeptides present in a biological sample that are derived from the biomarker precursor complexed to additional species, such as binding proteins, receptors, heparin, lipids, sugars, etc.

The term "subject" or "patient" as used herein, refers to a human or non-human organism. Thus, the methods and compositions described herein are equally applicable to both human and veterinary disease. Further, while a subject or patient is preferably a living organism, the invention described herein may be used in post-mortem analysis as well. Preferred subjects or patients are humans, which as used herein refer to living humans that are receiving medical care for a disease or condition.

The term "analyte" as used herein, refers to any measured compound or molecule. Preferably, an analyte is measured in a sample (i.e., for example, a body fluid sample). Such a sample may be obtained from a subject or patient, or may be obtained from biological materials intended to be provided to the subject or patient. For example, a sample may be obtained from a kidney being evaluated for possible transplantation into a subject, such that an analyte measurement may be used to evaluate the kidney for preexisting damage.

The term "body fluid sample" as used herein, refers to any sample of bodily fluid obtained for the purpose of diagnosis, prognosis, classification or evaluation of a subject of interest, such as a patient or transplant donor. In certain embodiments, such a sample may be obtained for the purpose of determining the outcome of an ongoing medical condition or the effect of a treatment regimen on a medical condition. Preferred body fluid samples include but are not limited to, blood, serum, plasma, cerebrospinal fluid, urine, saliva, sputum, or pleural effusions. In addition, certain body fluid samples may be more readily analyzed following a fractionation or purification procedure, for example, separation of whole blood into serum or plasma components.

The term "diagnosis" as used herein, refers to methods by which trained medical personnel can estimate and/or determine the probability (i.e., for example, a likelihood) of whether or not a patient is suffering from a given disease or condition. In the case of the present invention, "diagnosis" includes correlating the results of an assay (i.e., for example, an immunoassay) for a renal biomarker of the present invention, optionally together with other clinical indicia, to determine the occurrence or nonoccurrence of an acute renal injury or acute renal failure for a subject or patient from which a sample was obtained and assayed. That such a diagnosis is "determined" is not meant to imply that the diagnosis is 100% accurate. Thus, for example, a measured biomarker level below a predetermined diagnostic threshold may indicate a greater likelihood of the occurrence of a disease in the subject relative to a measured biomarker level above the predetermined diagnostic threshold may indicate a lesser likelihood of the occurrence of the same disease.

The term "prognosis" as used herein, refers to a probability (i.e., for example, a likelihood) that a specific clinical outcome will occur. For example, a level or a change in level of a prognostic indicator, which in turn is associated with an increased probability of morbidity (e.g., worsening renal function, future ARF, or death) is referred to as being "indicative of an increased likelihood" of an adverse outcome in a patient.

The term "RIFLE" criteria, as used herein, refers to any quantitative clinical evaluation of renal status used to establish renal classifications of Risk, Injury, Failure, Loss, & End Stage Renal Disease based upon a uniform definition of acute kidney injury (AKI). Kellum, Crit. Care Med. 36: S141-45 (2008); and Ricci et al., Kidney Int. 73, 538-546 (2008), each hereby incorporated by reference in its entirety.

The term, "modified RIFLE criteria", as used herein, provide alternative classifications for stratifying AKI patients, and may include, Stage I, Stage II, and/or Stage III. Mehta et al., Crit. Care 11:R31 (2007), hereby incorporated by reference in its entirety.

The term, "Stage I", as used herein, refers to a risk stratification comprising a RIFLE Risk category, characterized by an increase in serum creatinine of more than or equal to 0.3 mg/dL (≥26.4 µmol/L) and/or an increase to more than or equal to 150% (1.5-fold) from baseline. Alternatively, the category may be defined by a urine output less than 0.5 mL/kg per hour for more than 6 hours.

The term, "Stage II", as used herein, refers a risk stratification comprising a RIFLE Injury category, characterized by an increase in serum creatinine to more than 200% (>2-fold) from baseline. Alternatively, the category may be defined by a urine output less than 0.5 mL/kg per hour for more than 12 hours.

The term, "Stage III", as used herein, refers to a risk stratification comprising a RIFLE Failure category, characterized by an increase in serum creatinine to more than 300% (>3-fold) from baseline and/or serum creatinine >354 µmol/L accompanied by an acute increase of at least 44 µmol/L. Alternatively, the category may be defined by a urine output less than 0.3 mL/kg per hour for 24 hours or anuria for 12 hours.

The term "Risk category", as used herein, refers to a RIFLE classification wherein, in terms of serum creatinine, means any increase of at least 1.5 fold from baseline, or urine production of <0.5 ml/kg body weight/hr for approximately 6 hours.

The term "Injury category" as used herein includes, refers to a RIFLE classification wherein, in terms of serum creatinine, means any increase of at least 2.0 fold from baseline or urine production <0.5 ml/kg/hr for 12 h.

The term "Failure category" as used herein includes, refers to a RIFLE classification wherein, in terms of serum creatinine means any increase of at least 3.0 fold from baseline or a urine creatinine >355 µmol/l (with a rise of >44) or urine output below 0.3 ml/kg/hr for 24 h, or anuria for at least 12 hours.

The term "Loss category" as used herein, refers to a clinical outcome risk and/or a RIFLE classification wherein the clinical outcome risk is characterized by a persistent need for renal replacement therapy for more than four weeks.

The term "End Stage Renal Disease category" or "ESRD category" as used herein, refers to a clinical outcome risk and/or a RIFLE classification characterized by a need for dialysis for more than 3 months.

The term "clinical outcome risk" as used herein, refers to a medical prognosis directed towards either renal recovery or renal non-recovery.

The term "renal biomarker" as used herein, refers to any biological compound related to the progressive development of chronic kidney disease. In particular, a renal biomarker may be a kidney injury marker. For example, a renal biomarker may comprise a urinary protein, or any metabolite and/or derivative thereof, wherein the renal biomarker is either overexpressed or underexpressed as a result of an AKI.

The term "positive going biomarker" as that term is used herein, refers to any biomarker that is determined to be elevated in subjects suffering from a disease or condition, relative to subjects not suffering from that disease or condition.

The term "negative going biomarker" as that term is used herein, refer to any biomarker that is determined to be reduced in subjects suffering from a disease or condition, relative to subjects not suffering from that disease or condition.

The term "positive going renal biomarker value" as used herein, refers to any increased likelihood (i.e., for example, increased probability) of suffering a future injury to renal function assigned to a subject when the measured biomarker concentration is above a specified threshold value, relative to a likelihood assigned when the measured biomarker concentration is below the specified threshold value. Alternatively, when the measured biomarker concentration is below a specified threshold value, an increased likelihood of a non-occurrence of an injury to renal function may be assigned to the subject relative to the likelihood assigned when the measured biomarker concentration is above the specified threshold value. Alternatively, when the measured biomarker concentration is below the threshold value, an improvement of renal function may be assigned to the subject. A positive going kidney injury marker may include, but not be limited to, an increased likelihood of one or more of: acute kidney injury, progression to a worsening stage of AKI, mortality, a requirement for renal replacement therapy, a requirement for withdrawal of renal toxins, end stage renal disease, heart failure, stroke, myocardial infarction, progression to chronic kidney disease, etc.

The term "negative going renal biomarker value" as used herein, refers to any increased likelihood (i.e., for example, an increased probability) of suffering a future injury to renal function assigned to the subject when the measured biomarker concentration is below a specified threshold value, relative to a likelihood assigned when the measured biomarker concentration is above the threshold value. Alternatively, when the measured biomarker concentration is above the threshold value, an increased likelihood of a non-occurrence of an injury to renal function may be assigned to the subject relative to the likelihood assigned when the measured biomarker concentration is below the threshold value. Alternatively, when the measured biomarker concentration is above the threshold value, an improvement of renal function may be assigned to the subject. A negative going kidney injury marker may include, but not be limited to, an increased likelihood of one or more of: acute kidney injury, progression to a worsening stage of AM, mortality, a requirement for renal replacement therapy, a requirement for withdrawal of renal toxins, end stage renal disease, heart failure, stroke, myocardial infarction, progression to chronic kidney disease, etc.

The term "pre-existing" and "pre-existence" as used herein, means any risk factor (i.e., for example, a renal biomarker) existing at the time a body fluid sample is obtained from the subject.

The term "predicting" as used herein, refers to a method of forming a prognosis and/or a stratification risk assignment, wherein a medically trained person analyzes biomarker information, and optionally with relevant clinical indicia and/or demographic information.

The term "acute renal disease/failure/injury" as used herein, refers to any progressive worsening of renal function over hours to Days, resulting in the retention of nitrogenous wastes (such as urea nitrogen) and creatinine in the blood. Retention of these substances may also be referred to as, azotemia. In: Current Medical Diagnosis & Treatment 2008, 47th Ed, McGraw Hill, New York, pages 785-815, herein incorporated by reference in their entirety.

The term "chronic renal disease/failure/injury" as used herein, refers to a medical condition wherein exemplary symptoms may include, but are not limited to, hyperphosphatemia (i.e., for example, >4.6 mg/dl) or low glomerular filtration rates (i.e., for example, <90 ml/minute per 1.73 m2 of body surface). However, many CKD patients may have normal serum phosphate levels in conjunction with a sustained reduction in glomerular filtration rate for 3 or more months, or a normal GFR in conjunction with sustained evidence of a structural abnormality of the kidney. In some cases, patients diagnosed with chronic kidney disease are placed on hemodialysis to maintain normal blood homeostasis (i.e., for example, urea or phosphate levels). Alternatively, "chronic kidney disease" refers to a medical condition wherein a patients has either i) a sustained reduction in GFR <60 mi/min per 1.73 m2 of body surface for 3 or more months; or ii) a structural or functional abnormality of renal function for 3 or more months even in the absence of a reduced GFR. Structural or anatomical abnormalities of the kidney could be defined as, but not limited to, persistent microalbuminuria or proteinuria or hematuria or presence of renal cysts. Chronic renal failure (chronic kidney disease) may also result from an abnormal loss of renal function over months to years. In: Current Medical Diagnosis & Treatment 2008, 47th Ed, McGraw Hill, New York, pages 785-815, herein incorporated by reference in their entirety.

The term "about" as used herein in the context of any of any assay measurements refers to +/−5% of a given measurement.

The term "asymptomatic" as used herein, refers to a patient and/or subject that does not have a renal disease and/or injury, wherein a renal disease and/or injury symptom may include, but is not limited to, having a reduced glomerular filtration rate (i.e., for example, between approximately 70-89 ml/min per 1.73 m2 of body surface) for less than three months.

The term "glomerular filtration rate" as used herein, refers to any measurement capable of determining kidney function. In general, a normal glomerular filtration rate ranges between approximately 120-90 ml/minute per 1.73 m2 of body surface. Compromised kidney function is assumed when glomerular filtration rates are less than 90 ml/minute per 1.73 m2 of body surface. Kidney failure is probable when glomerular filtration rates fall below approximately 30 ml/minute per 1.73 m2 of body surface. Dialysis is frequently initiated when glomerular filtration rates fall below approximately 15 ml/minute per 1.73 m2 of body surface.

The term "renal failure" as used herein, refers to any acute, sudden, and/or chronic loss of the ability of the kidneys to remove waste and concentrate urine without losing electrolytes.

The term "biological sample" as used herein, refers to any substance derived from a living organism. For example, a sample may be derived from blood as a urine sample, serum sample, a plasma sample, and or a whole blood sample. Alternatively, a sample may be derived from a tissue collected, for example, by a biopsy. Such a tissue sample may comprise, for example, kidney tissue, vascular tissue and/or heart tissue. A biological sample may also comprise body fluids including, but not limited to, urine, saliva, or perspiration.

The term "reagent" as used herein, refers to any substance employed to produce a chemical reaction so as to detect, measure, produce, etc., other substances. The term "antibody" as used herein refers to any peptide or polypeptide derived from, modeled after, or substantially encoded by, an immunoglobulin gene or immunoglobulin genes, or fragments thereof, capable of specifically binding an antigen or epitope. See, e.g. In: Fundamental Immunology, 3rd Edition, W. E. Paul, ed., Raven Press, N.Y. (1993); Wilson et al., J. Immunol. Methods 175:267-273 (1994); and Yarmush et al., J. Biochem. Biophys. Methods 25:85-97 (1992). The term antibody includes, but is not limited to, antigen-binding portions, i.e., "antigen binding sites" exemplified by fragments, subsequences, and/or complementarity determining regions (CDRs)) that retain capacity to bind antigen, including, but not limited to: (i) a Fab fragment, a monovalent fragment comprising VL, VH, CL or CH1 domains; (ii) a F(ab')2 fragment, a bivalent fragment comprising two Fab fragments linked by a disulfide bridge at the hinge region; (iii) a Fd fragment comprising VH and CH1 domains; (iv) a Fv fragment comprising VL and VH domains of a single arm of an antibody, (v) a dAb fragment (Ward et al., Nature 341:544-546 (1989)), which comprises a VH domain; or (vi) an isolated complementarity determining region (CDR). Single chain antibodies are also included by reference in the term "antibody."

The term "epitope" as used herein, refers to any antigenic determinant capable of specific binding to an antibody. Epitopes usually display chemically active surface molecules such as amino acids or sugar side chains and usually have specific three dimensional structural characteristics, as well as specific charge characteristics. Conformational and nonconformational epitopes may be distinguished in that the binding to the former but not the latter can be lost in the presence of denaturing solvents.

The term "correlating" as used herein, in reference to the use of biomarkers, refers to comparing the presence and/or amount of any biomarker(s) in a patient to its presence and/or amount in persons known to suffer from, or known to be at risk of, a given condition; or in persons known to be free of a given condition. Often, this takes the form of comparing an assay result in the form of a biomarker concentration to a predetermined threshold selected to be indicative of the occurrence or nonoccurrence of a disease or the likelihood of some future outcome.

DETAILED DESCRIPTION

Figure 1:
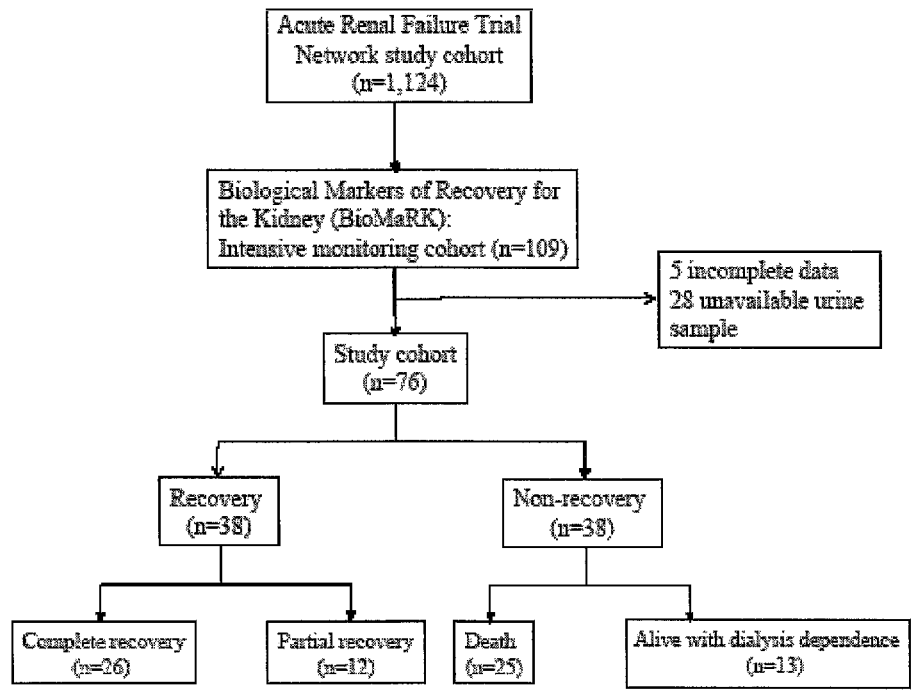
FIG. 1 presents exemplary subject information relevant to the Biological Markers of Recovery for the Kidney (BioMaRK) study cohort used as the basis for some of the data analysis presented herein.

This invention is related to the field of the prevention and treatment of kidney disease. The treatment of kidney disease may be tailored depending upon the need for, or expectation of, renal recovery. For example, prediction of renal recovery can be determined by monitoring urine biomarkers related to the development of chronic kidney disease. For example, differential expression platforms can be used to identify biomarker proteins in order to establish the risk of renal recovery versus renal non-recovery in patient's having suffered an acute kidney injury.

Despite significant advances in the epidemiology of acute kidney injury (AKI), prognostication remains a major clinical challenge. Unfortunately, there is no reliable method to predict renal recovery. The discovery of biomarkers to aid in clinical risk prediction for recovery after AM would represent a significant advance over current practice.

I. Kidney Injury and/or Disease

The kidney is responsible for water and solute excretion from the body. Its functions include maintenance of acid-base balance, regulation of electrolyte concentrations, control of blood volume, and regulation of blood pressure. As such, loss of kidney function through injury and/or disease results in substantial morbidity and mortality. A detailed discussion of renal injuries is provided in Harrison's Principles of Internal Medicine, 17th Ed., McGraw Hill, New York, pages 1741-1830, which are hereby incorporated by reference in their entirety. The kidneys are located in the flank (back of the upper abdomen at either side of the spinal column) They are deep within the abdomen and are protected by the spine, lower rib cage, and the strong muscles of the back. This location protects the kidneys from many external forces. They are well-padded for a reason—kidneys are highly vascular organs, which means that they have a large blood supply. If injury occurs, severe bleeding may result.

Kidneys may be injured by damage to the blood vessels that supply or drain them. This may be in the form of aneurysm, arteriovenous fistula, arterial blockage, or renal vein thrombosis. The extent of bleeding depends on the location and the degree of injury. Kidneys may also bleed profusely if they are damaged centrally (on the inside)—this is a life-threatening injury. Fortunately, most kidney injuries caused by blunt trauma occur peripherally, only causing bruising of the kidney (usually a self-limiting process).

People with undiagnosed kidney conditions—such as angiomyolipoma (benign tumor), ureteropelvic junction obstruction (congenital or acquired UPJ Obstruction), and other disorders—are more susceptible to kidney injuries and more likely to have serious complications if they occur. Other causes of kidney injury and bleeding are medical procedures. Kidney biopsies, nephrostomy tube placements, or other surgeries can cause an abnormal connection between an artery and vein (arteriovenous fistula). This is usually a self-limiting problem, but close observation is usually needed. Injury to the kidney can also disrupt the urinary tract, causing leakage of the urine from the kidney.

Each kidney filters about 1700 liters of blood per Day and concentrates fluid and waste products into about 1 liter of urine per Day. Because of this, the kidneys receive more exposure to toxic substances in the body than almost any other organ. Therefore, they are highly susceptible to injury from toxic substances. Analgesic nephropathy is one of the most common types of toxic damage to the kidney. Exposure to lead, cleaning products, solvents, fuels, or other nephrotoxic chemicals (those which can be toxic to the kidney) can damage kidneys. Excessive buildup of body waste products, such as uric acid (that can occur with gout or with treatment of bone marrow, lymph node, or other disorders) can also damage the kidneys.

Inflammation (irritation with swelling and presence of extra immune cells) caused by immune responses to medications, infection, or other disorders may also injure the structures of the kidney, usually causing various types of glomerulonephritis or acute tubular necrosis (tissue death). Autoimmune disorders may also damage the kidneys. Injury to the kidney may result in short-term damage with minimal or no symptoms. Alternately, it can be life-threatening because of bleeding and associated shock, or it may result in acute renal failure or chronic renal failure.

Ureteral injuries (injuries to the tubes which carry urine from the kidneys to the bladder) can also be caused by trauma (blunt or penetrating), complications from medical procedures, and other diseases in the retroperitoneum such as retroperitoneal fibrosis (RPF), retroperitoneal sarcomas, or metastatic lymph node positive cancers. Medical therapies (such as OB/GYN surgeries, prior radiation or chemotherapy, and previous abdominopelvic surgeries) increase the risk for ureteral injuries.

A. Acute Kidney Failure

Acute (sudden) kidney failure is the sudden loss of the ability of the kidneys to remove waste and concentrate urine without losing electrolytes. There are many possible causes of kidney damage including, but are not limited to, decreased blood flow, which may occur with extremely low blood pressure caused by trauma, surgery, serious illnesses, septic shock, hemorrhage, burns, or dehydration, acute tubular necrosis (ATN), infections that directly injury the kidney such as acute pyelonephritis or septicemia, urinary tract obstruction (obstructive uropathy), autoimmune kidney disease such as interstitial nephritis or acute nephritic syndrome, disorders that cause clotting within the thin blood vessels of the kidney, idiopathic thrombocytopenic thrombotic purpura (ITTP), transfusion reaction, malignant hypertension, scleroderma, hemolytic-uremic syndrome, disorders of childbirth, such as bleeding placenta abruptio or placenta previa Symptoms of acute kidney failure may include, but are not limited to, decrease in amount of urine (oliguria), urination stops (anuria), excessive urination at night, ankle, feet, and leg swelling, generalized swelling, fluid retention, decreased sensation, especially in the hands or feet, decreased appetite, metallic taste in mouth, persistent hiccups, changes in mental status or mood, agitation, drowsiness, lethargy, delirium or confusion, coma, mood changes, trouble paying attention, hallucinations, slow, sluggish, movements, seizures, hand tremor (shaking), nausea or vomiting, may last for Days, bruising easily, prolonged bleeding, nosebleeds, bloody stools, flank pain (between the ribs and hips), fatigue, breath odor, or high blood pressure.

Acute renal failure (ARF) may also be referred to as acute kidney injury (AKI) and may be characterized by an abrupt (i.e., for example, typically detected within about 48 hours to 1 week) reduction in glomerular filtration rate (GFR). This loss of filtration capacity results in retention of nitrogenous (urea and creatinine) and non-nitrogenous waste products that are normally excreted by the kidney, a reduction in urine output, or both. It is reported that ARF complicates about 5% of hospital admissions, 4-15% of cardiopulmonary bypass surgeries, and up to 30% of intensive care admissions. ARF may be categorized as prerenal, intrinsic renal, or postrenal in causation. Intrinsic renal disease can be further divided into glomerular, tubular, interstitial, and vascular abnormalities. Major causes of ARF are described in association with their respective risk factors are summarized below. See, Table 4; In: Merck Manual, 17th ed., Chapter 222, and which is hereby incorporated by reference in their entirety.

TABLE 4

Representative Acute Renal Failure Risk Factors

| Type of Renal Failure | Risk Factors |
|---|---|
| Prerenal | |
| ECF volume depletion | Excessive diuresis, hemorrhage, GI losses, loss of intravascular fluid into the extravascular space (due to ascites, peritonitis, pancreatitis, or burns), loss of skin and mucus membranes, renal salt- and water-wasting states |
| Low cardiac output | Cardiomyopathy, MI, cardiac tamponade, pulmonary embolism, pulmonary hypertension, positive-pressure mechanical ventilation |

TABLE 4-continued

Representative Acute Renal Failure Risk Factors

| Type of Renal Failure | Risk Factors |
|---|---|
| Low systemic vascular resistance | Septic shock, liver failure, antihypertensive drugs |
| Increased renal vascular resistance | NSAIDs, cyclosporines, tacrolimus, hypercalcemia, anaphylaxis, anesthetics, renal artery obstruction, renal vein thrombosis, sepsis, hepatorenal syndrome |
| Decreased efferent arteriolar tone (leading to decreased GFR from reduced glomerular transcapillary pressure, especially in patients with bilateral renal artery stenosis) | ACE inhibitors or angiotensin II receptor blockers |
| Intrinsic Renal | |
| Acute tubular injury | Ischemia (prolonged or severe prerenal state): surgery, hemorrhage, arterial or venous obstruction; Toxins: NSAIDs, cyclosporines, tacrolimus, aminoglycosides, foscarnet, ethylene glycol, hemoglobin, myoglobin, ifosfamide, heavy metals, methotrexate, radiopaque contrast agents, streptozotocin |
| Acute glomerulo-nephritis | ANCA-associated: Crescentic glomerulonephritis, polyarteritis nodosa, Wegener's granulomatosis; Anti-GBM glomerulonephritis: Goodpasture's syndrome; Immune-complex: Lupus glomerulonephritis, postinfectious glomerulonephritis, cryoglobulinemic glomerulonephritis |
| Acute tubulointerstitial nephritis | Drug reaction (eg, β-lactams, NSAIDs, sulfonamides, ciprofloxacin, thiazide diuretics, furosemide, phenytoin, allopurinol, pyelonephritis, papillary necrosis |
| Acute vascular nephropathy | Vasculitis, malignant hypertension, thrombotic microangiopathies, scleroderma, atheroembolism |
| Infiltrative diseases | Lymphoma, sarcoidosis, leukemia |
| Postrenal | |
| Tubular precipitation | Uric acid (tumor lysis), sulfonamides, triamterene, acyclovir, indinavir, methotrexate, ethylene glycol ingestion, myeloma protein, myoglobin |
| Ureteral obstruction | Intrinsic: Calculi, clots, sloughed renal tissue, fungus ball, edema, malignancy, congenital defects; Extrinsic: Malignancy, retroperitoneal fibrosis, ureteral trauma during surgery or high impact injury |
| Bladder obstruction | Mechanical: Benign prostatic hyperplasia, prostate cancer, bladder cancer, urethral strictures, phimosis, paraphimosis, urethral valves, obstructed indwelling urinary catheter; Neurogenic: Anticholinergic drugs, upper or lower motor neuron lesion |

In the case of ischemic ARF, the course of the disease may be divided into four phases. During an initiation phase, which lasts hours to Days, reduced perfusion of the kidney is evolving into injury. Glomerular ultrafiltration reduces, the flow of filtrate is reduced due to debris within the tubules, and back leakage of filtrate through injured epithelium occurs. Renal injury can be mediated during this phase by reperfusion of the kidney. Initiation is followed by an extension phase which is characterized by continued ischemic injury and inflammation and may involve endothelial damage and vascular congestion. During the maintenance phase, lasting from 1 to 2 weeks, renal cell injury occurs, and glomerular filtration and urine output reaches a minimum. A recovery phase can follow in which the renal epithelium is repaired and GFR gradually recovers. Despite this, the survival rate of subjects with ARF may be as low as about 60%.

Acute kidney injury caused by radiocontrast agents (also called contrast media) and other nephrotoxins such as cyclosporine, antibiotics including aminoglycosides and anticancer drugs such as cisplatin manifests over a period of Days to about a week. Contrast induced nephropathy (CIN, which is AKI caused by radiocontrast agents) is thought to be caused by intrarenal vasoconstriction (leading to ischemic injury) and from the generation of reactive oxygen species that are directly toxic to renal tubular epithelial cells. CIN classically presents as an acute (onset within 24-48 h) but reversible (peak 3-5 Days, resolution within 1 week) rise in blood urea nitrogen and serum creatinine.

A commonly reported criteria for defining and detecting AKI is an abrupt (typically within about 2-7 Days or within a period of hospitalization) elevation of serum creatinine. Although the use of serum creatinine elevation to define and detect AM is well established, the magnitude of the serum creatinine elevation and the time over which it is measured to define AM varies considerably among publications. Traditionally, relatively large increases in serum creatinine such as 100%, 200%, an increase of at least 100% to a value over 2 mg/dL and other definitions were used to define AKI. However, the recent trend has been towards using smaller serum creatinine rises to define AKI.

For example, relationships between elevated serum creatinine and AKI has been reported to be associated with health risks. Fraught et al., *Curr Opin Nephrol Hypertens* 14:265-270 (2005); and Chertow et al., *J Am Soc Nephrol* 16:3365-3370 (2005) (both references are herein incorporated by reference in their entirety). As described in these publications, acute worsening renal function (AKI) and increased risk of death and other detrimental outcomes are now known to be associated with very small increases in serum creatinine. These creatinine increases may be determined as a relative (percent) value or a nominal value. Relative increases in serum creatinine as small as 20% from the pre-injury value have been reported to indicate acutely worsening renal function (AM) and increased health risk, but the more commonly reported value to define AKI and increased health risk is a relative increase of at least 25%. Nominal increases as small as 0.3 mg/dL, 0.2 mg/dL or even 0.1 mg/dL have been reported to indicate worsening renal function and increased risk of death. Various time periods for the serum creatinine to rise to these threshold values have been used to define AKI, for example, ranging from 2 Days, 3 Days, 7 Days, or a variable period defined as the time the patient is in the hospital or intensive care unit. These studies indicate there is not a particular threshold serum creatinine rise (or time period for the rise) for worsening renal function or AKI, but rather a continuous increase in risk with increasing magnitude of serum creatinine rise.

Another study correlated serum creatinine levels with post-surgical mortality rates. Following heart surgery, patients with a mild fall in serum creatinine (i.e., for example, between approximately −0.1 to −0.3 mg/dL) had the lowest mortality rate, wherein patients had a larger mortality rate associated with either large falls in serum creatinine (i.e., for example, more than or equal to −0.4 mg/dL), or an increase in serum creatinine. Lassnigg et al., *J Am Soc Nephrol* 15:1597-1605 (2004), herein incorporated by reference in its entirety. These findings suggested that even very subtle changes in renal function, as detected by small creatinine changes within 48 hours of surgery, can be predictive of a patient's outcome.

A unified classification system using serum creatinine to define AM in clinical trials and in clinical practice was proposed to stratify AKI patients. Bellomo et al., *Crit Care* 8(4):R204-212 (2004), which is herein incorporated by reference in its entirety. For example, a serum creatinine rise of 25% may define contrast-induced nephropathy. McCollough et al, *Rev Cardiovasc Med.* 7(4):177-197 (2006), herein incorporated by reference in its entirety. Although various groups propose slightly different criteria for using serum creatinine to detect AKI, the consensus is that small changes in serum creatinine, such as 0.3 mg/dL (i.e., for example, approximately 25%) are sufficient to detect AM that characterizes a worsening renal function and that the magnitude of the serum creatinine change may be an indicator of the severity of the AKI and mortality risk.

Although serial measurement of serum creatinine over a period of Days is an accepted method of detecting and diagnosing AKI patients, serum creatinine is generally regarded to have several limitations in the diagnosis, assessment and monitoring of AKI patients. The time period for serum creatinine to rise to approximately 0.3 mg/dL (25%) is considered diagnostic for AM can be 48 hours or longer depending on the definition used.

Since cellular injury in AKI can occur over a period of hours, serum creatinine elevations detected at 48 hours or longer can be a late indicator of injury, and relying on serum creatinine can thus delay diagnosis of AKI. Furthermore, serum creatinine is not a good indicator of the exact kidney status and treatment needs during the most acute phases of AKI when kidney function is changing rapidly. Until defined by some embodiments of the present invention, there were no methods to determine whether some patients with AKI would recover fully, or whether some would need dialysis (either short term or long term), or whether some would have other detrimental outcomes including, but not limited to, death, major adverse cardiac events or chronic kidney disease. Because serum creatinine is a marker of filtration rate, it does not differentiate between the causes of AKI (pre-renal, intrinsic renal, post-renal obstruction, atheroembolic, etc) or the category or location of injury in intrinsic renal disease (for example, tubular, glomerular or interstitial in origin). Urine output is similarly limited.

These limitations underscore the need for better methods to detect and assess AKI, particularly in the early and subclinical stages, but also in later stages when recovery and repair of the kidney can occur. Furthermore, there is a need to better identify patients who are at risk of having an AKI.

B. Chronic Kidney Failure

Unlike acute renal failure, chronic renal failure slowly gets worse. It most often results from any disease that causes gradual loss of kidney function. It can range from mild dysfunction to severe kidney failure. Chronic renal failure may lead to end-stage renal disease (ESRD).

Chronic renal failure usually occurs over a number of years as the internal structures of the kidney are slowly damaged. In the early stages, there may be no symptoms. In fact, progression may be so slow that symptoms do not occur until kidney function is less than one-tenth of normal.

Chronic renal failure and ESRD affect more than 2 out of 1,000 people in the United States. Diabetes and high blood pressure are the two most common causes and account for most cases. Other major causes include, but are not limited to, Alport syndrome, analgesic nephropathy, glomerulonephritis of any type (one of the most common causes), kidney stones and infection, obstructive uropathy, polycystic kidney disease, or reflux nephropathy. Chronic renal failure results in an accumulation of fluid and waste products in the body, leading to a build up of nitrogen waste products in the blood (azotemia) and general ill health. Most body systems are affected by chronic renal failure.

Initial symptoms may include, but are not limited to, fatigue, frequent hiccups, general ill feeling, generalized itching (pruritus), headache, nausea, vomiting, or unintentional weight loss. Further, later symptoms may include, but are not limited to, blood in the vomit or in stools, decreased alertness, including drowsiness, confusion, delirium, orcoma, decreased sensation in the hands, feet, or other areas, easy bruising or bleeding, increased or decreased urine output, muscle twitching or cramps, seizures, or white crystals in and on the skin (uremic frost).

Circulating levels of cytokines and other inflammation markers are markedly elevated in patients with chronic renal failure. This could be caused by increased generation, decreased removal, or both. However, it is not well established to what extent renal function per se contributes to the uremic proinflammatory milieu. Relationships between inflammation and glomerular filtration rate (GFR) were reported in 176 patients (age, 52+/−1 years; GFR, 6.5+/−0.1 mL/min) close to the initiation of renal replacement therapy. Pecoits-Filho et al., "Associations between circulating inflammatory markers and residual renal function in CRF patients" *Am J Kidney Dis.* 41(6):1212-1218 (2003). For example, circulating levels of high-sensitivity C-reactive protein (hsCRP), tumor necrosis factor-alpha (TNF-alpha), interleukin-6 (IL-6), hyaluronan, and neopterin were measured after an overnight fast. Patients subsequently were subdivided into two groups according to median GFR (6.5 mL/min). Despite the narrow range of GFR (1.8 to 16.5 mL/min), hsCRP, hyaluronan, and neopterin levels were significantly greater in the subgroup with lower GFRs, and significant negative correlations were noted between GFR and IL-6 (rho=−0.18; P<0.05), hyaluronan (rho=−0.25; P<0.001), and neopterin (rho=−0.32; P<0.0005). In a multivariate analysis, age and GFR were associated with inflammation but cardiovascular disease and diabetes mellitus were not. These results show that a low GFR per se is associated with an inflammatory state, suggesting impaired renal elimination of proinflammatory cytokines, increased generation of cytokines in uremia, or an adverse effect of inflammation on renal function.

C. Dialysis

Dialysis (i.e., for example, renal replacement therapy) is a method of removing toxic substances (impurities or wastes) from the blood when the kidneys are unable to do so and can be performed using several different methods. For example, peritoneal dialysis may filter waste by using the peritoneal membrane inside the abdomen. The abdomen is filled with special solutions that help remove toxins. The solutions remain in the abdomen for a time and then are drained out. This form of dialysis can be performed at home, but must be done every Day. Alternatively, hemodialysis may be performed by circulating the blood through special filters outside the body. The blood flows across a filter, along with solutions that help remove toxins.

Dialysis uses special ways of accessing the blood in the blood vessels. The access can be temporary or permanent. Temporary access takes the form of dialysis catheters—hollow tubes placed in large veins that can support acceptable blood flows. Most catheters are used in emergency situations for short periods of time. However, catheters called tunneled catheters can be used for prolonged periods of time, often weeks to months. Permanent access is created by surgically joining an artery to a vein. This allows the vein to receive blood at high pressure, leading to a thickening of the vein's wall. This vein can handle repeated puncture and also provides excellent blood flow rates. The connection between an artery and a vein can be made using blood vessels (an arteriovenous fistula, or AVF) or a synthetic bridge (arteriovenous graft, or AVG). Blood is diverted from the access point in the body to a dialysis machine. Here, the blood flows counter-current to a special solution called the dialysate. The chemical imbalances and impurities of the blood are corrected and the blood is then returned to the body. Typically, most patients undergo hemodialysis for three sessions every week. Each session lasts 3-4 hours.
The purpose of dialysis is to assist kidney functions including, filters for the blood, removing waste products, regulating body water, maintaining electrolyte balance, or maintaining blood pH remains between 7.35 and 7.45. Further, dialysis may replace some of the functions for kidneys that aren't working properly that would otherwise result in the death of a patient.

Dialysis is most often used for patients who have kidney failure, but it can also quickly remove drugs or poisons in acute situations. This technique can be life saving in people with acute or chronic kidney failure.

II. Urinary Renal Biomarkers

Currently, no effective treatments exist to improve renal recovery, or to improve short and long-term renal outcome, after AKI. Furthermore, methods to predict recovery are also lacking. The emerging role of biomarkers for early detection of renal disease and/or renal injury may help identify new prognostic tools to predict renal clinical outcomes. Potential candidates for biomarkers of renal recovery include, but are not limited to, molecules expressed in pathways leading to regeneration and proliferation as well as markers of fibrosis and apoptosis. In addition, renal injury biomarkers may also serve to distinguish early resolution, and hence increased odds of recovery.

Acute kidney injury (AKI) has an estimated incidence rate of approximately 2000 per million population and this rate is increasing. Ali et al., "Incidence and outcomes in acute kidney injury: a comprehensive population-based study" *J Am Soc Nephrol* 18:1292-1298 (2007). Approximately 5% of all people admitted to intensive care units around the world develop severe AM requiring dialysis. Uchino et al., "Acute renal failure in critically ill patients: a multinational, multicenter study" *JAMA* 294:813-818 (2005). A recent, United States multi-center study found that fewer than only about 60% patients surviving severe AKI recovered renal function by two months. Palevsky et al., "Intensity of renal support in critically ill patients with acute kidney injury" *N Engl J Med* 359:7-20 (2008). Thus, a large number of patients with AKI progress into end-stage renal disease (ESRD).

However, since only a fraction of patients with AKI fail to recover renal function, interventions aimed at improving recovery or at providing renal support (e.g. early dialysis) cannot be selectively targeted appropriately without some means of determining which patients will recover and which will not recover (i.e., for example, the availability of non-invasive biomarkers). Currently, clinical risk prediction for recovery after AKI is extremely limited. Thus, development of a non-invasive biomarker that allows early prediction of recovery of kidney function is a long felt need in the art of renal disease management.

The identification of such non-invasive biomarkers (i.e., for example, a urinary biomarker) would greatly improve long-term prognosis thereby tailoring research efforts to treat AM and prevent ESRD. In other words, having the ability to predict which patients will not recover kidney function allows a clinician to focus limited resources on the development and application of aggressive treatment interventions on these predicted at-risk patients. Conversely, patients with a favorable prognosis would be spared from more aggressive interventions and their potential adverse effects, thereby releasing medical resources to those in need and reducing overall medical costs.

In one embodiment, the present invention contemplates methods and compositions for evaluating renal function in a subject. As described herein, measurement of various kidney injury markers described herein can be used for diagnosis, prognosis, risk stratification, staging, monitoring, categorizing and a determination of further diagnosis and treatment regimens in subjects suffering or at risk of suffering from an injury to renal function, reduced renal function, and/or acute renal failure (also called acute kidney injury).

Renal biomarkers as described herein may be used individually, or in panels, comprising a plurality of renal biomarkers, for risk stratification. In one embodiment, risk stratification identifies subjects at risk for a future: i) injury to renal function; ii) progression to reduced renal function; iii) progression to ARF; or iv) improvement in renal function, etc. In one embodiment, risk stratification diagnoses an existing disease, comprising identifying subjects who have: i) suffered an injury to renal function; ii) progressed to reduced renal function; or iii) progressed to ARF, etc. In one embodiment, risk stratification monitors for deterioration and/or improvement of renal function. In one embodiment, risk stratification predicts a future medical outcome including, but not limited to, an improved or worsening renal function, a decreased or increased mortality risk, a decreased or increased risk that a subject will require initiation or continuation of renal replacement therapy (i.e., hemodialysis, peritoneal dialysis, hemofiltration, and/or renal transplantation, a decreased or increased risk that a subject will recover from an injury to renal function, a decreased or increased risk that a subject will recover from ARF, a decreased or increased risk that a subject will progress to end stage renal disease, a decreased or increased risk that a subject will progress to chronic renal failure, a decreased or increased risk that a subject will suffer rejection of a transplanted kidney, etc.

III. Clinical Renal Biomarker Studies

The results of a large multicenter clinical trial has recently been reported comparing two intensities of renal support for critically ill patients with acute kidney injury (AKI) in which recovery of renal function was less than 25% at 28 days and not different between the two treatment strategies. Palevsky et al., "Intensity of renal support in critically ill patients with acute kidney injury" *N Engl J Med* 359:7-20 (2008). These results emphasize that incomplete renal recovery is a common problem in the patients who survive severe AKI. Uchino et al., "Acute renal failure in critically ill patients: a multinational, multicenter study" *JAMA*, 294: 813-818 (2005). Failure to recover renal function can have tremendous negative effects on quality of life and health care costs. Manns et al., "Cost of acute renal failure requiring dialysis in the intensive care unit: clinical and resource implications of renal recovery" *Crit Care Med*, 31:449-455 (2003). Therefore, treatments to hasten and facilitate renal recovery are eagerly being sought by both the critical care and nephrology communities. Unfortunately, there are no effective treatments to improve renal recovery. One possible barrier to progress in this area has been the inability to forecast recovery in individual patients. The ability to prognosticate in an AKI patient population would be extremely valuable both for clinical decisions as well as to guide future research on therapy to promote recovery of renal function.

One clinical study reported that patients who recovered from AKI did not appear to differ in clinical characteristics (i.e., for example, age, gender, mechanical ventilation status, or clinical severity scores) from the non-recovery group. Bhandari et al., "Survivors of acute renal failure who do not recover renal function" QJM, 89:415-421 (1996). Secondary analysis from three randomized controlled trials (RCTs) comparing efficacy of continuous renal replacement therapy (RRT) versus intermittent RRT found that: i) APACHE III scores >100; ii) cardiovascular instability; and iii) pre-existing renal impairment were all associated with renal non-recovery. Mehta et al., "A randomized clinical trial of continuous versus intermittent dialysis for acute renal failure" Kidney Int, 60:1154-1163 (2001); Augustine et al., "A randomized controlled trial comparing intermittent with continuous dialysis in patients with ARF" Am J Kidney Dis, 44:1000-1007 (2004); and Uehlinger et al., "Comparison of continuous and intermittent renal replacement therapy for acute renal failure" Nephrol Dial Transplant, 20:1630-1637 (2005), respectively. However, these studies did not adhere to a uniform definition of, or standard timing, to assess renal recovery.

Other studies have suggested that baseline creatinine and urine output at the time of discontinuation of RRT were most predictive of recovery. Uchino et al., "Discontinuation of continuous renal replacement therapy: a post hoc analysis of a prospective multicenter observational study" Crit Care Med, 37:2576-2582 (2009). However, urine output was analyzed after RRT had ended based on a clinical decision rather than at a fixed time point (e.g. 14 Days post AKI) to predict renal recovery. Therefore, these data are compromised to suggest that urine output was predictive of renal recovery, and further, baseline creatinine might have been less valuable because patients with stage 4 and 5 CKD were excluded.

Recently, a number of urinary biomarkers have been investigated for the purpose of early diagnosis of AM. Since these markers correlate with renal tubular cell injury or function, their patterns in the urine, either alone or in combination, could provide new prognostic information regarding renal recovery. For example, several reports have suggested possible candidate renal biomarkers relating to three aspects of the physiology of renal recovery:

i) inflammatory markers including; a) urinary neutrophil gelatinase-associated lipocalin (uNGAL), which has been extensively studied for predicting AKI (Supavekin et al., "Differential gene expression following early renal ischemia/reperfusion" Kidney Int, 63:1714-1724 (2003); Mishra et al., "Kidney NGAL is a novel early marker of acute injury following transplantation" Pediatr Nephrol, 21:856-863 (2006); Hirsch et al., "NGAL is an early predictive biomarker of contrast-induced nephropathy in children" Pediatr Nephrol, 22: 2089-2095 (2007); and Zappitelli et al., "Urine neutrophil gelatinase-associated lipocalin is an early marker of acute kidney injury in critically ill children: a prospective cohort study" Crit Care, 11: R84 (2007); b) matrix metalloproteinase protein-9 (MMP-9), a matrix degradation enzyme which is up-regulated after ischemic injury in animal models and links to NGAL by a disulfide bond forming urinary NGAL/MMP-9 (uNGAL/MMP-9) (Ronco et al., "Matrix metalloproteinases in kidney disease progression and repair: a case of flipping the coin" Semin Nephrol, 27:352-362 (2007); and c) urinary interleukin-18 (uIL-18), an inflammatory cytokine which is found to potentiate ischemic AKI and has been tested in many clinical settings (Parikh et al., "Urine IL-18 is an early diagnostic marker for acute kidney injury and predicts mortality in the intensive care unit" J Am Soc Nephrol, 16:3046-3052 (2005); and Parikh et al., "Urinary IL-18 is an early predictive biomarker of acute kidney injury after cardiac surgery" Kidney Int, 70:199-203 (2006);

ii) growth factors including urinary hepatocyte growth factor (uHGF), a biomarker linked to renal tubular epithelial cell regeneration (Liu et al., "Hepatocyte growth factor: new arsenal in the fights against renal fibrosis? Kidney Int, 70:238-240 (2006); and iii) filtration and tubular reabsorption markers, such as cystatin C, which is freely filtered and is normally completely reabsorbed by proximal tubular epithelial cells and urine creatinine. Herget-Rosenthal et al., "Measurement of urinary cystatin C by particle-enhanced nephelometric immunoassay: precision, interferences, stability and reference range" Ann Clin Biochem, 41:111-118 (2004).

Despite these reports, only a few suggest biomarkers having an ability to predict AKI severity. But no study has identified a biomarker as a predictor of renal recovery. Coca et al., "Biomarkers for the diagnosis and risk stratification of acute kidney injury: a systematic review" Kidney Int, 73:1008-1016 (2008). The data presented herein provide heretofore unknown renal biomarkers identified by proteomic gene expression analysis. The data was obtained from urine samples collected during a clinical study as described below.

The data presented herein was collected from 109 patients in the BioMaRK clinical study where 76 patients had complete data available including urine samples. Exactly half (38 patients) recovered renal function (alive and without requirement for dialysis) by day 60. See, FIG. 1. Baseline clinical characteristics of the study patients were taken. See, Table 1.

TABLE 1

Summary of baseline and clinical characteristics of the study patients

| Characteristics | All subjects (n = 76) | Recovery (n = 38) | Non-recovery (n = 38) | P value |
| --- | --- | --- | --- | --- |
| Age, mean (SD), -yr | 58.4(17.0) | 52.2(15.7) | 64.7(16.2) | <0.001 |
| Gender: Female (%) | 30(39.5) | 15(39.5) | 15(39.5) | 1.00 |
| Race: White (%) | 64(84.2) | 30(79.0) | 34(89.5) | 0.21 |
| Baseline serum creatinine, mean (SD) (mg/dl) | 1.1(0.4) | 1.1(0.4) | 1.2(0.5) | 0.45 |
| BUN at initiation of RRT, mean (SD) (mg/dl) | 55.6(29.9) | 51.3(28.8) | 59.9(30.8) | 0.23 |
| Cause of acute kidney injury | | | | |
| Ischemia (%) | 66(86.8) | 29(76.3) | 37(97.4) | 0.007 |
| Nephrotoxins (%) | 16(21.3) | 10(26.3) | 6(16.2) | 0.29 |
| Sepsis (%) | 50(65.8) | 23(60.5) | 27(71.1) | 0.33 |

TABLE 1-continued

Summary of baseline and clinical characteristics of the study patients

| Characteristics | All subjects (n = 76) | Recovery (n = 38) | Non-recovery (n = 38) | P value |
|---|---|---|---|---|
| Multifactorial causes (%) | 51(68.0) | 25(65.8) | 26(70.3) | 0.68 |
| Length of ICU stay before randomization-days, mean (SD) | 5.4(4.1) | 4.2(2.8) | 6.5(4.9) | 0.03 |
| Length of hospital stay before randomization-days, mean (SD) | 8.5(7.1) | 6.7(5.0) | 10.2(8.5) | 0.08 |
| Charlson comorbidity index[a], mean (SD) | 4.1(3.3) | 3.3(3.8) | 4.9(2.7) | 0.008 |
| Mechanical ventilation (%) | 69(90.8) | 34(89.5) | 35(92.1) | 1.00 |
| Sepsis[b] (%) | 47(62.7) | 22(57.9) | 25(67.6) | 0.39 |
| APACHE II score[c], mean (SD) | 23.4(7.2) | 21.8(7.2) | 25.0(6.8) | 0.06 |
| Non-renal SOFA organ-system score[d], mean (SD) | | | | |
| Respiratory | 2.1(1.3) | 2.1(1.5) | 2.1(1.2) | 0.98 |
| Coagulation | 1.5(1.3) | 1.4(1.3) | 1.5(1.3) | 0.58 |
| Liver | 0.9(1.3) | 1.2(1.5) | 0.6(1.0) | 0.08 |
| Cardiovascular | 2.2(1.7) | 2.0(1.7) | 2.5(1.6) | 0.17 |
| Central nervous system | 2.2(1.4) | 2.3(1.3) | 2.1(1.5) | 0.45 |
| Total | 8.9(4.0) | 9.2(4.6) | 8.5(3.3) | 0.43 |
| Cleveland Clinic ICU ARF Renal Failure score[e], mean (SD) | 11.9(3.0) | 11.6(3.0) | 12.2(3.0) | 0.49 |
| Intensive strategy[f] (%) | 34(44.7) | 18(47.4) | 16(42.1) | 0.64 |

Abbreviations: RRT, Renal Replacement Therapy. ICU, Intensive Care Unit. APACHE II, Acute Physiology and Chronic Health Evaluation II. SOFA, Sequential Organ Failure Assessment. ARF, Acute Renal Failure.
[a]According to the method of Charlson et al.[28]
[b]Defined as sepsis plus acute organ dysfunction according to 2001 international consensus criteria for sever sepsis.[26]
[c]According to the method of Knaus et al.[29]
[d]Non renal SOFA score, excluding the renal part, assessed on the first day according to the method of Vincent et al.[30]
[e]According to the method of Thakar et al.[31]
[f]Intensive strategy, intermittent hemodialysis and sustained low-efficiency dialysis were provided six times per week (every day except Sunday), and continuous venovenous hemodiafiltration was prescribed to provide a flow rate of the total effluent (the sum of the dialysate and ultrafiltrate) of 35 ml per kilogram of body weight per hour, based on the weight before the onset of acute illness.[1]

Patients recovering from renal injury were more likely to be younger, had a shorter length of intensive care unit (ICU) stay before randomization, lower Charlson comorbidity index, and lower nonrenal SOFA score as compared to those not recovering renal function. By contrast, there were no statistical differences in gender, ethnicity, baseline serum creatinine, blood urea nitrogen (BUN) at initiation of RRT, length of hospital stay, length of ICU stay, requirement for mechanical ventilation, Cleveland Clinic ICU Acute Renal Failure (ARF) score, or intensity of RRT. The primary etiology of AKI was ischemia in both groups. However, a significantly lower percentage of ischemia (76.3%) was noted as the cause of AKI in the recovery group compared to 97.4% in non-recovery group. Of the 38 participants who recovered renal function, 26 (68.4%) had complete recovery. Among those failing to recover renal function, 25 patients (65.8%), did not survive past day 60.

IV. Proteomics Gene Expression Platforms

In one embodiment, the present invention contemplates a method for identifying urinary biomarkers using a proteomics platform. In one embodiment, the proteomics platform detects protein expression profiles. In one embodiment, the method further comprises comparing a first protein expression profile to a second protein expression profile. In one embodiment, the comparing identifies an overexpressed protein in the first protein expression profile relative to the second protein expression profile. In one embodiment, the comparing identifies an underexpressed protein in the first protein expression profile relative to the second protein expression profile.

A Introduction

In one embodiment, the present invention contemplates a method comprising a proteomics platform (i.e., for example, iTRAQ) capable of summarizing an analysis of relative protein biomarker expression. For example, the proteomics platform may use reporter ion peak area measurements (i.e., for example, supplied by ABI software) to estimate treatment-dependent peptide and protein biomarker relative expression. Such estimations may be accomplished using a Bayesian approach. The proteomics platform described herein includes a protein biomarker relative expression summary and a per-protein biomarker detailed analysis.

B Experiment and Model Description

1. Experiment Design

Proteomic platforms contemplated herein may summarize data from one or more experiments addressing a common comparison. For example, a possible experimental design for such an analysis is presented below. See, Table 5.

TABLE 5

Representative Proteomic Experimental Designs

| Experiment | Treatment | Channel | Sample |
|---|---|---|---|
| 1 | A | A | 113 | A1 |
| 2 | A | A | 114 | A2 |
| 3 | A | A | 115 | A3 |
| 4 | A | A | 116 | A4 |
| 5 | A | B | 117 | B1 |
| 6 | A | B | 118 | B2 |
| 7 | A | B | 119 | B4 |
| 8 | A | B | 121 | B4 |

2. Input Files

Data for proteomic analyses may be extracted from input files including but not limited to a tandem mass spectra (MSMS) summary file, such as:

Experiment *MSMS* Summary File
A SCW_XIII_70.bit

3. Statistical Modeling

Statistical models to estimate the treatment-dependent effects may including but not limited to: LogIntensity~Channel+Spectrum+Protein+Peptide+Protein:Treatment+Peptide: Treatment.

4. Data Summarization

The proteomics platform may comprise filtering the data supplied in the MSMS summary to remove unidentified proteins, contaminants, and/or peptides containing selected modifications. A representative analysis may provide a data summary as presented below. See, Table 6.

TABLE 6

Representative Data Summary

|  | A | Combined |
| --- | --- | --- |
| Supplied Spectra | 4608 | 4608 |
| Unidentified Spectra | 0 | 0 |
| Disallowed Modifications | 249 | 249 |
| Spectra from Contaminants | 1210 | 1210 |
| Missing Data | 115 | 115 |
| Low Confidence Spectra | 0 | 0 |
| Degenerate Peptides | 379 | 379 |
| Remaining Spectra |  | 2655 |
| Unique Proteins |  | 360 |
| Unique Peptides |  | 1473 |
| Model R2 |  | 0.767 |

C. Protein Biomarker Summary

Figure 2:
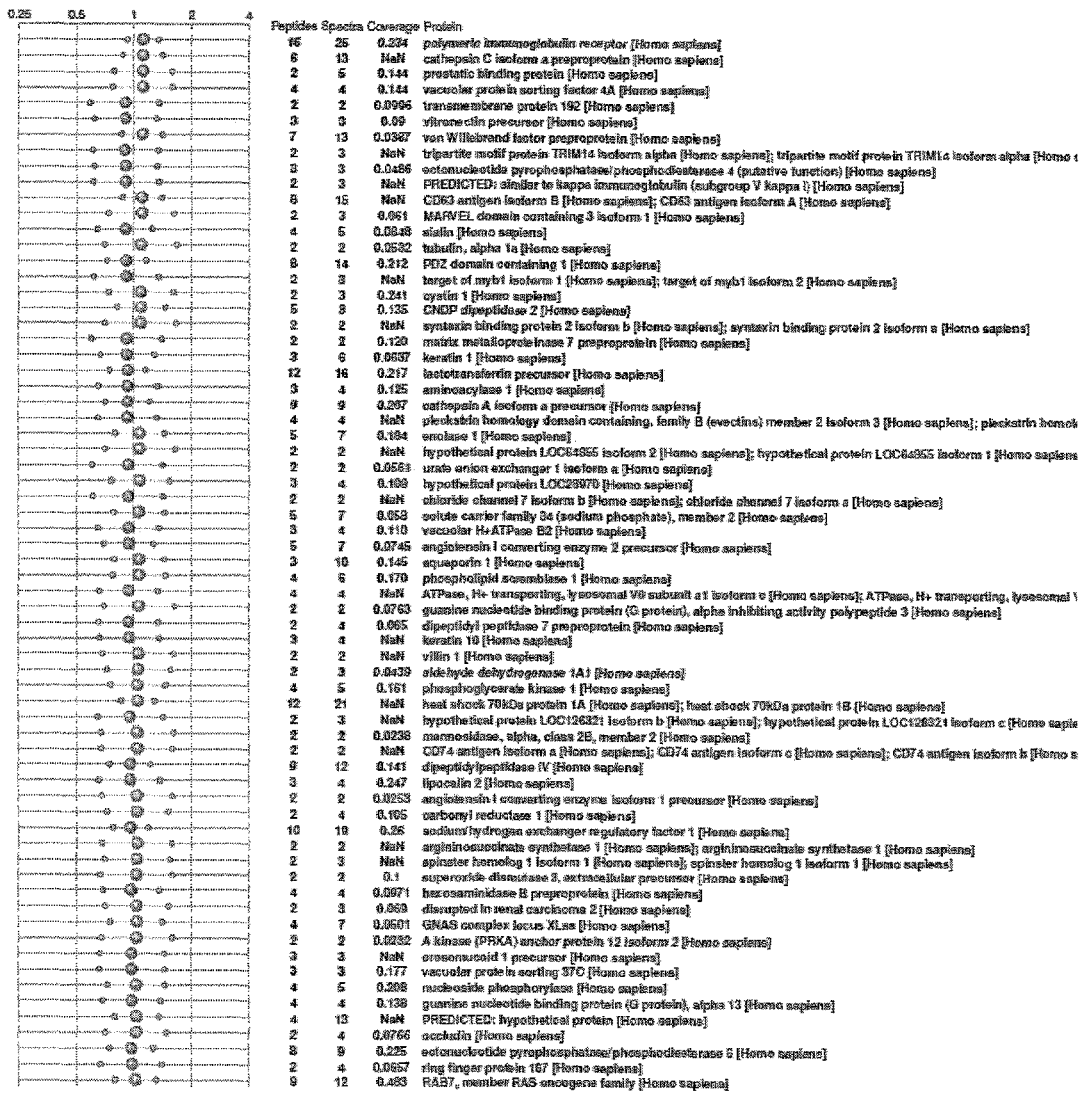
FIG. 2: Representative protein biomarker families identified by a proteomics platform FIG. 3 Representative single biomarker peptides Identified by a proteomics platform.
Figure 3:
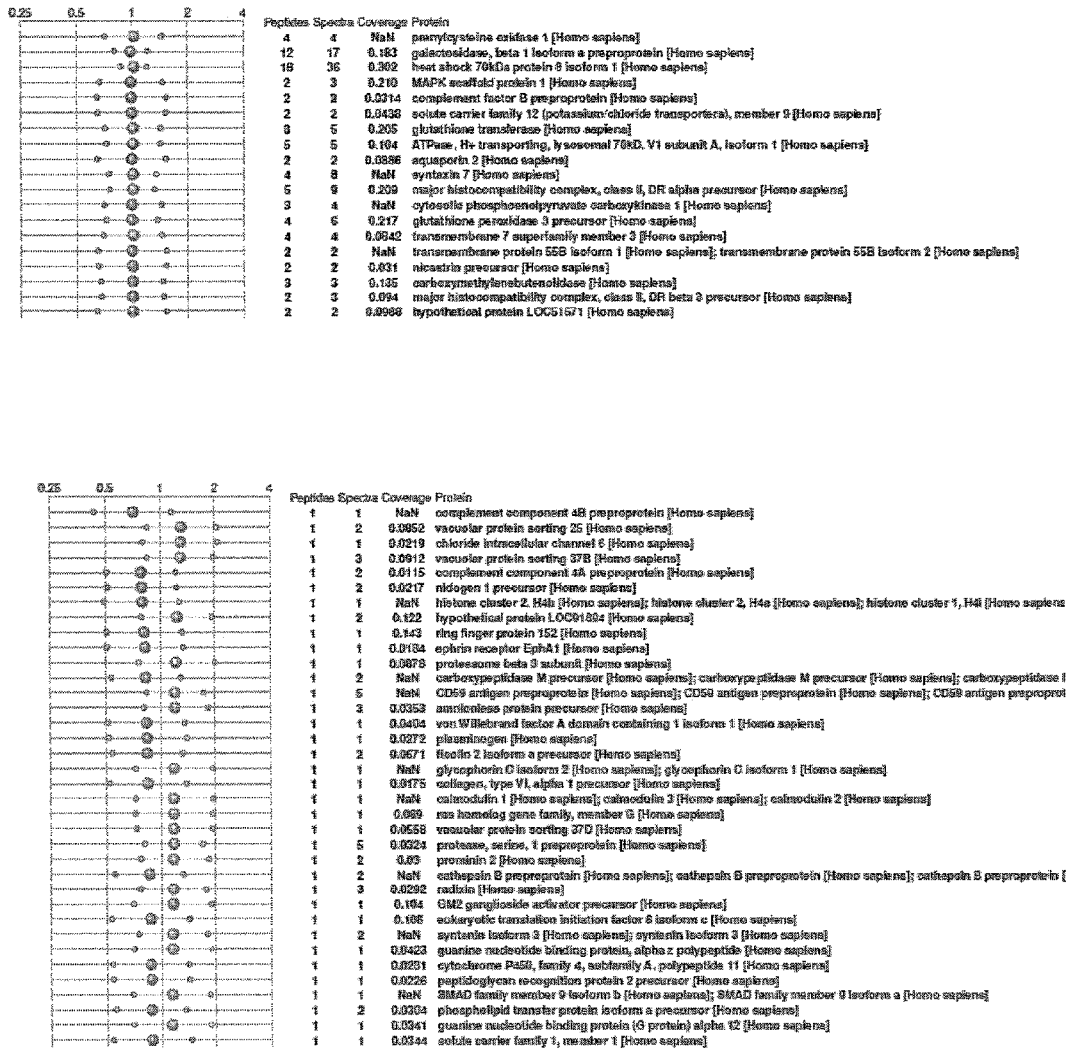
Figure 3:
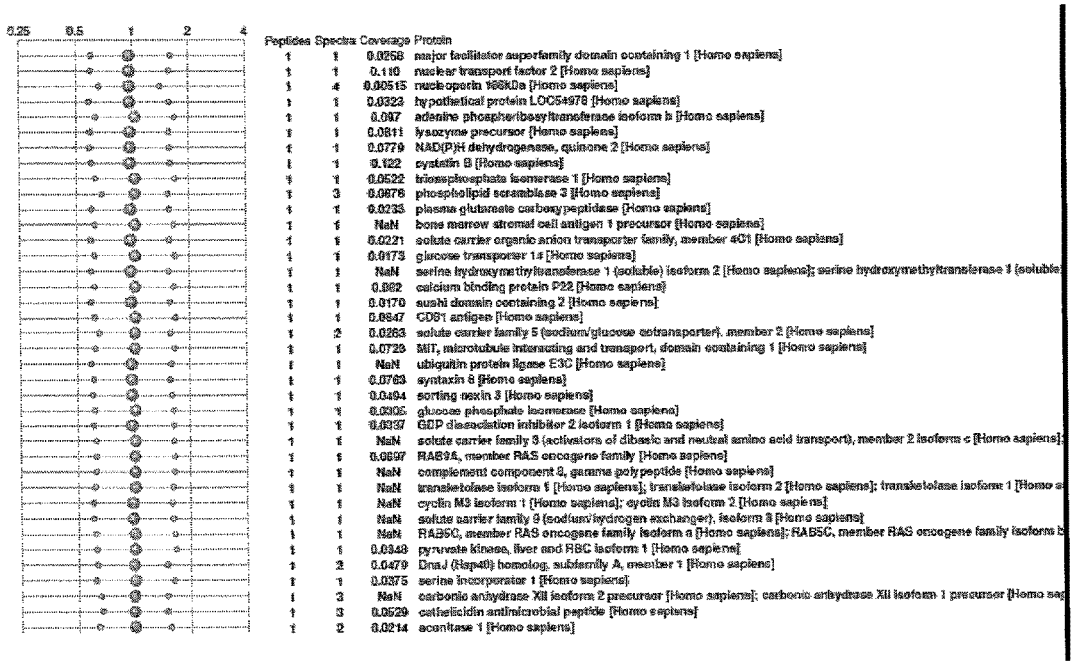

In one embodiment, the proteomics platform may identify each protein biomarker in one or more of the MSMS summaries, for example, in decreasing order of expression change magnitude. See, FIG. 2. The median and estimated credible interval for each protein biomarker is given to the left in the table. Similar data is shown where protein biomarkers are identified by a single peptide. See FIG. 3.

D. Protein Biomarker Details

A detailed summary of each protein biomarker is given below, wherein each protein biomarker is designated as 5.###. These sections include protein biomarker relative expression estimates in addition to protein-level estimates.

Lengthy table referenced here

US09551720-20170124-T00001

Please refer to the end of the specification for access instructions.

III. Renal Status Assay Measurements

The ability of a particular renal biomarker assay measurement to distinguish between two populations can be established using ROC analysis. For example, ROC curves established from a "first" subpopulation (i.e., for example, a population predisposed to one or more future changes in renal status) and a "second" subpopulation (i.e., for example, a population not predisposed to one or more future changes in renal status). Calculation of these ROC curves and establishing the area under these ROC curves quantitate the predictive power of the specific assay measurement. In some embodiments, predictive power established by assay measurements described herein comprise an AUC ROC greater than 0.5, preferably at least 0.6, more preferably 0.7, still more preferably at least 0.8, even more preferably at least 0.9, and most preferably at least 0.95.

A. Immunoassays

In general, immunoassays involve contacting a sample containing, or suspected of containing, a biomarker of interest with at least one antibody that specifically binds to the biomarker. A detectable signal is then generated indicative of the presence or amount of complexes formed by the binding of polypeptides in the sample to the antibody. The detectable signal is then related to the presence or amount of the biomarker in the sample. Numerous methods and devices have been reported regarding the detection and analysis of biological biomarkers. See, e.g., U.S. Pat. Nos. 6,143,576; 6,113,855; 6,019,944; 5,985,579; 5,947,124; 5,939,272; 5,922,615; 5,885,527; 5,851,776; 5,824,799; 5,679,526; 5,525,524; and 5,480,792, and The Immunoassay Handbook, David Wild, ed. Stockton Press, New York, 1994, each of which is herein incorporated by reference in its entirety, including all tables, figures and claims.

Numerous immunoassay devices and methods can utilize labeled molecules in various sandwich, competitive, or non-competitive assay formats, to generate a signal that is related to the presence or amount of the biomarker of interest. Suitable assay formats also include chromatographic, mass spectrographic, and protein "blotting" methods. Additionally, certain methods and devices, such as biosensors and optical immunoassays, may be employed to determine the presence or amount of analytes without the need for a labeled molecule. See, e.g., U.S. Pat. Nos. 5,631,171; and 5,955,377, each of which is herein incorporated by reference in its entirety, including all tables, figures and claims. Robotic instrumentation for performing these immunoassays are commercially available including, but not limited to, Beckman ACCESS®, Abbott AXSYM®, Roche ELECSYS®, Dade Behring STRATUS® systems. But any suitable immunoassay may be utilized, for example, enzyme-linked immunoassays (ELISA), radioimmunoassays (RIAs), competitive binding assays, and the like.

Antibodies or other polypeptides may be immobilized onto a variety of solid supports for use in immunoassays. Solid phases that may be used to immobilize specific binding members include, but are not limited to those developed and/or used as solid phases in solid phase binding assays. Examples of suitable solid phases include, but are not limited to, membrane filters, cellulose-based papers, beads (including polymeric, latex and paramagnetic particles), glass, silicon wafers, microparticles, nanoparticles, Tenta-Gels, AgroGels, PEGA gels, SPOCC gels, and multiple-well plates. For example, an assay strip could be prepared by coating the antibody or a plurality of antibodies in an array on solid support. This strip could then be dipped into the test sample and then processed quickly through washes and detection steps to generate a measurable signal, such as a colored spot. Antibodies or other polypeptides may be bound to specific zones of assay devices either by conjugating directly to an assay device surface, or by indirect binding. In an example of the later case, antibodies or other polypeptides may be immobilized on particles or other solid supports, and that solid support immobilized to the device surface.

In certain embodiments, a urinary renal biomarker assay method comprises an immunoassay. For example, antibodies for use in such assays may specifically bind an epitope of a renal biomarker of interest, and may also bind one or more polypeptides that are "related" thereto, as that term is defined hereinafter. In one embodiment, the renal biomarker of interest is a fully length marker (i.e., for example, a protein). In one embodiment, the renal biomarker of interest is a protein fragment marker (i.e., for example, a peptide). Numerous immunoassay formats are available compatible with body fluid samples including, but not limited to, urine, blood, serum, saliva, tears, and plasma.

In this regard, detectable signals obtained from an immunoassay may be a direct result of complexes formed between one or more antibodies and the target biomolecule (i.e., for example, an analyte) and polypeptides containing the necessary epitope(s) to which the antibodies bind. While such assays may detect the full length biomarker and the assay result be expressed as a concentration of a biomarker of interest, the signal from the assay may actually be a result of all such "immunoreactive" polypeptides present in the sample. Expression of biomarkers may also be determined by means other than immunoassays, including protein measurements (i.e., for example, dot blots, western blots, chromatographic methods, mass spectrometry, etc.) and nucleic acid measurements (mRNA quantitation). This list is not meant to be limiting.

The foregoing method steps should not be interpreted to mean that the renal biomarker assay measurements is/are used in isolation in the methods described herein. Rather, additional variables or other clinical indicia may be included in the methods described herein. For example, risk stratification, diagnostic, classification, monitoring, etc. methods as described herein may be combined with one or more clinical indicia relevant to the patient population including, but not limited to, demographic information (e.g., weight, sex, age, race), medical history (e.g., family history, type of surgery, pre-existing disease such as aneurism, congestive heart failure, preeclampsia, eclampsia, diabetes mellitus, hypertension, coronary artery disease, proteinuria, renal insufficiency, or sepsis, type of toxin exposure such as NSAIDs, cyclosporines, tacrolimus, aminoglycosides, foscarnet, ethylene glycol, hemoglobin, myoglobin, ifosfamide, heavy metals, methotrexate, radiopaque contrast agents, or streptozotocin), clinical variables (e.g., blood pressure, temperature, respiration rate), risk scores (APACHE score, PREDICT score, TIMI Risk Score for UA/NSTEMI, Framingham Risk Score), a glomerular filtration rate, an estimated glomerular filtration rate, a urine production rate, a serum or plasma creatinine concentration, a urine creatinine concentration, a fractional excretion of sodium, a urine sodium concentration, a urine creatinine to serum or plasma creatinine ratio, a urine specific gravity, a urine osmolality, a urine urea nitrogen to plasma urea nitrogen ratio, a plasma BUN to creatnine ratio, a renal failure index calculated as urine sodium/(urine creatinine/plasma creatinine), a serum or plasma neutrophil gelatinase (NGAL) concentration, a urine NGAL concentration, a serum or plasma cystatin C concentration, a serum or plasma cardiac troponin concentration, a serum or plasma BNP concentration, a serum or plasma NTproBNP concentration, and a serum or plasma proBNP concentration. Other measures of renal function which may be combined with one or more renal biomarker assay measurements are described hereinafter. In: Harrison's Principles of Internal Medicine, 17th Ed., McGraw Hill, New York, pages 1741-1830; and In: Current Medical Diagnosis & Treatment 2008, 47th Ed, McGraw Hill, New York, pages 785-815, each of which are herein incorporated by reference in their entirety.

When more than one biomarker is measured, the individual biomarkers may be measured in samples obtained at the same time, or may be determined from samples obtained at different (e.g., an earlier or later) times. The individual biomarkers may also be measured on the same or different body fluid samples. For example, one renal biomarker may be measured in a serum or plasma sample and another renal biomarker may be measured in a urine sample. In addition, assignment of a likelihood may combine a renal biomarker assay measurement with temporal changes in one or more additional variables.

B. Detectable Labels

Generation of a detectable signal from the detectable label can be performed using various optical, acoustical, and electrochemical methods. Examples of detection modes include, but are not limited to, fluorescence, radiochemical detection, reflectance, absorbance, amperometry, conductance, impedance, interferometry, ellipsometry, etc. In certain of these methods, the solid phase antibody may be coupled to a transducer (e.g., a diffraction grating, electrochemical sensor, etc) for generation of a signal, while in others, a signal is generated by a transducer that is spatially separate from the solid phase antibody (e.g., a fluorometer that employs an excitation light source and an optical detector). This list is not meant to be limiting. Antibody-based biosensors may also be employed to determine the presence or amount of analytes that optionally eliminate the need for a labeled molecule.

Biological assays require methods for detection, and one of the most common methods for quantitation of assay measurements is to conjugate a detectable label to a protein or nucleic acid that has affinity for one of the components in the biological system being studied. Detectable labels used in the immunoassays described above may include, but are not limited to, molecules that are themselves detectable (e.g., fluorescent moieties, electrochemical labels, ec1 (electrochemical luminescence) labels, metal chelates, colloidal metal particles, etc.) as well as molecules that may be indirectly detected by production of a detectable reaction product (e.g., enzymes such as horseradish peroxidase, alkaline phosphatase, etc.) or through the use of a specific binding molecule which itself may be detectable (e.g., a labeled antibody that binds to the second antibody, biotin, digoxigenin, maltose, oligohistidine, 2,4-dintrobenzene, phenylarsenate, ssDNA, dsDNA, etc.).

Preparation of solid phases and detectable label conjugates often comprise the use of chemical cross-linkers. Cross-linking reagents may involve at least two reactive groups, and are divided generally into homofunctional cross-linkers (containing identical reactive groups) and heterofunctional cross-linkers (containing non-identical reactive groups). Homobifunctional cross-linkers that couple through amines, sulfhydryls or react non-specifically are available from many commercial sources. Maleimides, alkyl and aryl halides, alpha-haloacyls and pyridyl disulfides are thiol reactive groups and are believed to react with sulfhydryls to form thiol ether bonds, while pyridyl disulfides react with sulfhydryls to produce mixed disulfides. The pyridyl disulfide product is cleavable. Imidoesters are also very useful for protein-protein cross-links. A variety of heterobifunctional cross-linkers, each combining different attributes for successful conjugation, are commercially available.

D. Assay Correlations

In some embodiments, the renal biomarker assay measurement is/are correlated to one or more future changes in renal function. In one embodiment, risk stratification comprises determining a subject's likelihood (i.e., for example, probability) for a future improvement in renal function.

In one embodiment, the renal biomarker assay measurement is/are correlated to a likelihood of such a future improvement in renal function. In one embodiment, the method correlates a likelihood of such a future injury to renal function. In one embodiment, the risk stratification comprises determining a subject's risk for progression to acute renal failure (ARF).

In one embodiment, the renal biomarker assay measurement is/are correlated to a likelihood of such progression to acute renal failure (ARF). In one embodiment, the risk stratification method comprises determining a subject's outcome risk.

In one embodiment, the assay measurement is/are correlated to a likelihood of the occurrence of a clinical outcome related to a renal injury suffered by the subject.

Consequently, the measured concentration value(s) may each be compared to a threshold value, wherein either a "positive going kidney injury marker", or a "negative going kidney injury marker" is identified. In one embodiment, the risk stratification comprises determining a subject's risk for future reduced renal function. In some embodiments, the method assigns a likelihood, risk, or probability that such that an event of interest is more or less likely to occur within 180 Days of the time at which the body fluid sample is obtained from the subject. In some embodiments, the assigned likelihood, risk, or probability relates to an event of interest occurring within a time period including, but not limited to, 18 months, 120 Days, 90 Days, 60 Days, 45 Days, 30 Days, 21 Days, 14 Days, 7 Days, 5 Days, 96 hours, 72 hours, 48 hours, 36 hours, 24 hours, 12 hours, or less. Alternatively, assigning a risk at 0 hours of the time at which the body fluid sample is obtained from the subject is equivalent to diagnosis of a current condition.

Selecting a diagnostic threshold involves, among other things, consideration of the probability of disease, distribution of true and false diagnoses at different test thresholds, and estimates of the consequences of treatment (or a failure to treat) based on the diagnosis. For example, when considering administering a specific therapy which is highly efficacious and has a low level of risk, few tests are needed because clinicians can accept substantial diagnostic uncertainty. On the other hand, in situations where treatment options are less effective and more risky, clinicians often need a higher degree of diagnostic certainty. Thus, a cost/benefit analysis is involved in selecting a diagnostic threshold.

1. Thresholds

Suitable thresholds may be determined in a variety of ways. For example, one recommended diagnostic threshold for the diagnosis of acute myocardial infarction uses cardiac troponin, wherein the diagnostic threshold is set at the 97.5th percentile of the cardiac troponin concentration measured in a normal population. Another method to determine a diagnostic threshold comprises measuring serial samples from the same patient, where a prior "baseline" result is used to monitor for temporal changes in a biomarker level.

Population studies may also be used to select thresholds. For example, Receiver Operating Characteristic ("ROC") arose from the field of signal detection theory developed during World War II for the analysis of radar images, and ROC analysis is often used to select a threshold to distinguish a "diseased" subpopulation from a "nondiseased" subpopulation. Predictive power balances the occurrences of false positives (i.e., for example, when the person tests positive, but actually does not have the disease) and false negatives (i.e., for example, when the person tests negative, suggesting they are healthy, when they actually do have the disease). To draw a ROC curve, the true positive rate (TPR) and false positive rate (FPR) are determined as the decision threshold is varied continuously. Since TPR is equivalent with sensitivity and FPR is equal to (1−specificity), the ROC graph is sometimes called the sensitivity vs (1−specificity) plot. A perfect test will have an area under the ROC curve of 1.0; a random test will have an area of 0.5. A threshold value is selected to provide an acceptable level of specificity and sensitivity usually determined by summing specificity values with sensitivity values. Consequently, the larger the calculated threshold value the greater the predicative power of the specific assay measurement under analysis.

In this context, "diseased" is meant to refer to a population having one characteristic (i.e., for example, the presence of a disease or condition or the occurrence of some outcome) and "nondiseased" population lacking the same characteristic. While a single decision threshold is the simplest application of such a method, multiple decision thresholds may be used. For example, below a first threshold, the absence of disease may be assigned with relatively high confidence, and above a second threshold the presence of disease may also be assigned with relatively high confidence. Between the two thresholds may be considered indeterminate. This is meant to be exemplary in nature only.

In addition to threshold value comparisons, other methods for correlating assay measurements to a patient classification (i.e., for example, occurrence or nonoccurrence of disease, likelihood of an outcome, etc.) include, but are not limited to, decision trees, rule sets, Bayesian methods, and neural network methods. These methods can produce probability values representing the degree to which a subject or patient belongs to one classification out of a plurality of classifications.

Multiple thresholds may also be used to assess renal status in a subject and/or patient. For example, a multiple thresholding method may combine a "first" subpopulation which is predisposed to one or more future changes in renal status, the occurrence of an injury, a classification, etc., with a "second" subpopulation which is not so predisposed into a single group. This combination group is then subdivided into three or more equal parts (i.e., for example, tertiles, quartiles, quintiles, etc., depending on the number of subdivisions). An odds ratio is assigned to subjects based on which subdivision they fall into. If one considers a tertile embodiment, the lowest or highest tertile can be used as a reference for comparison of the other subdivisions. This reference subdivision is assigned an odds ratio of 1. The second tertile is assigned an odds ratio that is relative to that first tertile. That is, someone in the second tertile might be 3 times more likely to suffer one or more future changes in renal status in comparison to someone in the first tertile. The third tertile is also assigned an odds ratio that is relative to that first tertile.

2. Specificity and Sensitivity

In some embodiments, a measured concentration of one or more renal biomarkers, or a composite of such biomarkers, may be treated as continuous variables. For example, any particular biomarker concentration can be converted into a corresponding probability of a future reduction in renal function for the subject, the occurrence of an injury, a classification, etc. Alternatively, a threshold value can provide an acceptable level of specificity and sensitivity in separating a population of subjects into "bins" such as a "first" subpopulation (e.g., which is predisposed to one or more future changes in renal status, the occurrence of an injury, a classification, etc.) and a "second" subpopulation which is not so predisposed.

In one embodiment, a threshold value is selected to separate a first and a second population by one or more of the following measures of test accuracy:

i) an odds ratio greater than 1, preferably at least about 2 or more or about 0.5 or less, more preferably at least about 3 or more or about 0.33 or less, still more preferably at least about 4 or more or about 0.25 or less, even more preferably at least about 5 or more or about 0.2 or less, and most preferably at least about 10 or more or about 0.1 or less;

ii) a specificity of greater than 0.5, preferably at least about 0.6, more preferably at least about 0.7, still more preferably at least about 0.8, even more preferably at least about 0.9 and most preferably at least about 0.95, with a corresponding sensitivity greater than 0.2, preferably greater than about 0.3, more preferably greater than about 0.4, still more preferably at least about 0.5, even more preferably about 0.6, yet more preferably greater than about 0.7, still more preferably greater than about 0.8, more preferably greater than about 0.9, and most preferably greater than about 0.95;

iii) a sensitivity of greater than 0.5, preferably at least about 0.6, more preferably at least about 0.7, still more preferably at least about 0.8, even more preferably at least about 0.9 and most preferably at least about 0.95, with a corresponding specificity greater than 0.2, preferably greater than about 0.3, more preferably greater than about 0.4, still more preferably at least about 0.5, even more preferably about 0.6, yet more preferably greater than about 0.7, still more preferably greater than about 0.8, more preferably greater than about 0.9, and most preferably greater than about 0.95;

iv) at least about 75% sensitivity, combined with at least about 75% specificity; a positive likelihood ratio (calculated as sensitivity/(1-specificity)) of greater than 1, at least about 2, more preferably at least about 3, still more preferably at least about 5, and most preferably at least about 10; or v) a negative likelihood ratio (calculated as (1-sensitivity)/specificity) of less than 1, less than or equal to about 0.5, more preferably less than or equal to about 0.3, and most preferably less than or equal to about 0.1.

Various measures of test accuracy have been reported and used to determine the effectiveness of a given biomarker. Fischer et al., Intensive Care Med. 29:1043-1051 (2003). These accuracy measures include, but are not limited to, sensitivity and specificity, predictive values, likelihood ratios, diagnostic odds ratios, and AUC ROC values. For example, AUC ROC values are equal to the probability that a classifier will rank a randomly chosen positive instance higher than a randomly chosen negative one. Consequently, an AUC ROC value may be thought of as equivalent to the Mann-Whitney U test, which tests for the median difference between scores obtained in the two groups considered if the groups are of continuous data, or to the Wilcoxon test of ranks.

As discussed above, suitable tests may exhibit one or more of the following results on these various measures: a specificity of greater than 0.5, preferably at least 0.6, preferably at least 0.7, still more preferably at least 0.8, even more preferably at least 0.9 and most preferably at least 0.95, with a corresponding sensitivity greater than 0.2, preferably greater than 0.3, more preferably greater than 0.4, still more preferably at least 0.5, even more preferably 0.6, yet more preferably greater than 0.7, still more preferably greater than 0.8, more preferably greater than 0.9, and most preferably greater than 0.95; a sensitivity of greater than 0.5, preferably at least 0.6, more preferably at least 0.7, still more preferably at least 0.8, even more preferably at least 0.9 and most preferably at least 0.95, with a corresponding specificity greater than 0.2, preferably greater than 0.3, more preferably greater than 0.4, still more preferably at least 0.5, even more preferably 0.6, yet more preferably greater than 0.7, still more preferably greater than 0.8, more preferably greater than 0.9, and most preferably greater than 0.95; at least 75% sensitivity, combined with at least 75% specificity; a ROC curve area of greater than 0.5, preferably at least 0.6, more preferably 0.7, still more preferably at least 0.8, even more preferably at least 0.9, and most preferably at least 0.95; an odds ratio different from 1, preferably at least about 2 or more or about 0.5 or less, more preferably at least about 3 or more or about 0.33 or less, still more preferably at least about 4 or more or about 0.25 or less, even more preferably at least about 5 or more or about 0.2 or less, and most preferably at least about 10 or more or about 0.1 or less; a positive likelihood ratio (calculated as sensitivity/(1-specificity)) of greater than 1, at least 2, more preferably at least 3, still more preferably at least 5, and most preferably at least 10; and or a negative likelihood ratio (calculated as (1-sensitivity)/specificity) of less than 1, less than or equal to 0.5, more preferably less than or equal to 0.3, and most preferably less than or equal to 0.1.

G. Conventional Renal Diagnostics

As noted above, the terms "acute renal (or kidney) injury" and "acute renal (or kidney) failure" as used herein are generally defined, in part, in terms of changes in serum creatinine from a baseline value. Most conventional definitions of ARF have common elements, including but not limited to the use of serum creatinine and, often, urine output. Patients may present with renal dysfunction without an available baseline measure of renal function for use in this comparison. In such an event, one may estimate a baseline serum creatinine value by assuming the patient initially had a normal GFR.

1. Glomerular Filtration Rate and Creatinine

Glomerular filtration rate (GFR) is generally definded as the volume of fluid filtered from the renal (kidney) glomerular capillaries into the Bowman's capsule per unit time. Glomerular filtration rate (GFR) can be calculated by measuring any chemical that has a steady level in the blood, and is freely filtered but neither reabsorbed nor secreted by the kidneys. GFR is typically expressed in units of ml/min:

By normalizing the GFR to the body surface area, a GFR of approximately 75-100 ml/min per 1.73 $m^2$ can be assumed. The rate therefore measured is the quantity of the substance in the urine that originated from a calculable volume of blood.

There are several different techniques used to calculate or estimate the glomerular filtration rate (GFR or eGFR). In clinical practice, however, creatinine clearance is used to measure GFR. Creatinine is produced naturally by the body (creatinine is a metabolite of creatine, which is found in muscle). It is freely filtered by the glomerulus, but also actively secreted by the renal tubules in very small amounts such that creatinine clearance overestimates actual GFR by 10-20%. This margin of error is acceptable considering the ease with which creatinine clearance is measured.

Creatinine clearance (CCr) can be calculated if values for creatinine's urine concentration (UCr), urine flow rate (V), and creatinine's plasma concentration (PCr) are known. Since the product of urine concentration and urine flow rate yields creatinine's excretion rate, creatinine clearance is also said to be its excretion rate (UCr×V) divided by its plasma concentration. This is commonly represented mathematically as:

$$C_{Cr} = \frac{U_{Cr} \times V}{P_{Cr}}$$

Commonly a 24 hour urine collection is undertaken, from empty-bladder one morning to the contents of the bladder the following morning, with a comparative blood test then taken:

$$C_{Cr} = \frac{U_{Cr} \times 24\text{-hour volume}}{P_{Cr} \times 24 \times 60 \text{ mins}}$$

To allow comparison of results between people of different sizes, the CCr is often corrected for the body surface area (BSA) and expressed compared to the average sized man as ml/min/1.73 m². While most adults have a BSA that approaches 1.7 (1.6-1.9), extremely obese or slim patients should have their CCr corrected for their actual BSA:

$$C_{Cr\text{-corrected}} = \frac{C_{Cr} \times 1.73}{BSA}$$

The accuracy of a creatinine clearance measurement (even when collection is complete) is limited because as glomerular filtration rate (GFR) falls creatinine secretion is increased, and thus the rise in serum creatinine is less. Thus, creatinine excretion is much greater than the filtered load, resulting in a potentially large overestimation of the GFR (as much as a twofold difference). However, for clinical purposes it is important to determine whether renal function is stable or getting worse or better. This is often determined by monitoring serum creatinine alone. Like creatinine clearance, the serum creatinine will not be an accurate reflection of GFR in the non-steady-state condition of ARF. Nonetheless, the degree to which serum creatinine changes from baseline will reflect the change in GFR. Serum creatinine is readily and easily measured and it is specific for renal function.

For purposes of determining urine output on a mL/kg/hr basis, hourly urine collection and measurement is adequate. In the case where, for example, only a cumulative 24-h output was available and no patient weights are provided, minor modifications of the RIFLE urine output criteria have been described. For example, some have assumed an average patient weight of 70 kg, wherein patients are assigned a RIFLE classification based on the following: <35 mL/h (Risk), <21 mL/h (Injury) or <4 mL/h (Failure). Bagshaw et al., *Nephrol. Dial. Transplant.* 23:1203-1210 (2008).

2. Treatment Regimen Selection

Once a renal diagnosis is obtained, the clinician can readily select a treatment regimen that is compatible with the diagnosis, such as initiating renal replacement therapy, withdrawing delivery of compounds that are known to be damaging to the kidney, kidney transplantation, delaying or avoiding procedures that are known to be damaging to the kidney, modifying diuretic administration, initiating goal directed therapy, etc. Various appropriate treatments for numerous diseases have been previously discussed in relation to the methods of diagnosis described herein. See, e.g., Merck Manual of Diagnosis and Therapy, 17th Ed. Merck Research Laboratories, Whitehouse Station, N J, 1999. In addition, since the methods and compositions described herein provide prognostic information, the renal biomarkers of the present invention may be used to monitor a course of treatment. For example, an improved prognostic state or a worsened prognostic state may indicate that a particular treatment is or is not efficacious.

IV. Antibodies

Antibodies used in the immunoassays described herein preferably specifically bind to a kidney injury marker of the present invention. The term "specifically binds" is not intended to indicate that an antibody binds exclusively to its intended target since, as noted above, an antibody binds to any polypeptide displaying the epitope(s) to which the antibody binds. Rather, an antibody "specifically binds" if its affinity for its intended target is about 5-fold greater when compared to its affinity for a non-target molecule which does not display the appropriate epitope(s). Preferably the affinity of the antibody will be at least about 5 fold, preferably 10 fold, more preferably 25-fold, even more preferably 50-fold, and most preferably 100-fold or more, greater for a target molecule than its affinity for a non-target molecule. In some embodiments, antibodies bind with affinities of at least about $10^7$ M$^{-1}$, and preferably between about $10^8$ M$^{-1}$ to about $10^9$ M$^{-1}$, about $10^9$ M$^{-1}$ to about $10^{10}$ M$^{-1}$, or about $10^{10}$ M$^{-1}$ to about $10^{12}$ M$^{-1}$.

Affinity may be calculated as $K_d = k_{off}/k_{on}$ ($k_{off}$ is the dissociation rate constant, $K_{on}$ is the association rate constant and Kd is the equilibrium constant). Affinity can be determined at equilibrium by measuring the fraction bound (r) of labeled ligand at various concentrations (c). The data are graphed using the Scatchard equation: r/c=K(n−r): where r=moles of bound ligand/mole of receptor at equilibrium; c=free ligand concentration at equilibrium; K=equilibrium association constant; and n=number of ligand binding sites per receptor molecule. By graphical analysis, r/c is plotted on the Y-axis versus r on the X-axis, thus producing a Scatchard plot. Antibody affinity measurement by Scatchard analysis is well known in the art. See, e.g., van Erp et al., *J. Immunoassay* 12:425-443 (1991); and Nelson et al., *Comput. Methods Programs Biomed.* 27: 65-68 (1988).

Numerous publications discuss the use of phage display technology to produce and screen libraries of polypeptides for binding to a selected analyte. See, e.g., Cwirla et al., *Proc. Nati. Acad. Sci. USA* 87: 6378-6382 (1990); Devlin et al., *Science* 249:404-406 (1990); Scott et al., *Science* 249: 386-388 (1990); and Ladner et al., U.S. Pat. No. 5,571,698 (all references herein incorporated by reference). A basic concept of phage display methods is the establishment of a physical association between DNA encoding a polypeptide to be screened and the polypeptide. This physical association is provided by the phage particle, which displays a polypeptide as part of a capsid enclosing the phage genome which encodes the polypeptide. The establishment of a physical association between polypeptides and their genetic material allows simultaneous mass screening of very large numbers of phage bearing different polypeptides. Phage displaying a polypeptide with affinity to a target bind to the target and these phage are enriched by affinity screening to the target. The identity of polypeptides displayed from these phage can be determined from their respective genomes. Using these methods a polypeptide identified as having a binding affinity for a desired target can then be synthesized in bulk by conventional means. See, e.g., U.S. Pat. No. 6,057,098, which is hereby incorporated in its entirety, including all tables, figures, and claims.

Antibodies generated by these methods may then be selected by first screening for affinity and specificity with the purified polypeptide of interest and, if required, comparing the results to the affinity and specificity of the antibodies with polypeptides that are desired to be excluded from binding. The screening procedure can involve immobilization of the purified polypeptides in separate wells of microtiter plates. The solution containing a potential antibody or groups of antibodies is then placed into the respective microtiter wells and incubated for about 30 min to 2 h. The microtiter wells are then washed and a labeled secondary antibody (for example, an anti-mouse antibody conjugated to alkaline phosphatase if the raised antibodies are mouse antibodies) is added to the wells and incubated for about 30 min and then washed. Substrate is added to the wells and a color reaction will appear where antibody to the immobilized polypeptide(s) are present.

Antibodies so identified may then be further analyzed for affinity and specificity in the assay design selected. In the development of immunoassays for a target protein, the purified target protein acts as a standard with which to judge the sensitivity and specificity of the immunoassay using the antibodies that have been selected. Because the binding affinity of various antibodies may differ; certain antibody pairs (e.g., in sandwich assays) may interfere with one another sterically, etc., assay performance of an antibody may be a more important measure than absolute affinity and specificity of an antibody.

V. Kits

In some embodiments, the present invention also contemplates devices and kits for performing the methods described herein. Suitable kits comprise reagents sufficient for performing an assay for at least one of the described kidney injury markers, together with instructions for performing the described threshold comparisons.

In certain embodiments, reagents for performing such assays are provided in an assay device, and such assay devices may be included in such a kit. Preferred reagents can comprise one or more solid phase antibodies, the solid phase antibody comprising antibody that detects the intended biomarker target(s) bound to a solid support. In the case of sandwich immunoassays, such reagents can also include one or more detectably labeled antibodies, the detectably labeled antibody comprising antibody that detects the intended biomarker target(s) bound to a detectable label. Additional optional elements that may be provided as part of an assay device are described hereinafter.

In some embodiments, the present invention provides kits for the analysis of the described kidney injury markers. The kit comprises reagents for the analysis of at least one test sample which comprise at least one antibody that a kidney injury marker. The kit can also include devices and instructions for performing one or more of the diagnostic and/or prognostic correlations described herein. Preferred kits will comprise an antibody pair for performing a sandwich assay, or a labeled species for performing a competitive assay, for the analyte. Preferably, an antibody pair comprises a first antibody conjugated to a solid phase and a second antibody conjugated to a detectable label, wherein each of the first and second antibodies that bind a kidney injury marker. Most preferably each of the antibodies are monoclonal antibodies. The instructions for use of the kit and performing the correlations can be in the form of labeling, which refers to any written or recorded material that is attached to, or otherwise accompanies a kit at any time during its manufacture, transport, sale or use. For example, the term labeling encompasses advertising leaflets and brochures, packaging materials, instructions, audio or video cassettes, computer discs, as well as writing imprinted directly on kits.

EXPERIMENTAL

Example I

BioMaRK Data Collection Method

Patients and Study Design

BioMaRK was an observational cohort study conducted as an ancillary study to the Veterans Affairs/National Institutes of Health (VA/NIH) Acute Renal Failure Trial Network study (ATN study). The ATN study was a multicenter, prospective trial of two strategies for renal replacement therapy in critically ill patients with acute kidney injury. Coca et al., "Biomarkers for the diagnosis and risk stratification of acute kidney injury: a systematic review" *Kidney Int*, 73:1008-1016 (2008). Adult patients (18 years or older) with AKI and requiring renal-replacement therapy (RRT), as well as failure of one or more non-renal organ systems or sepsis were eligible. As a sub-study to the ATN study, 109 patients were enrolled at The University of Pittsburgh Medical Center, The VA Pittsburgh Healthcare System, The Cleveland Clinical Foundation, The University of Texas Health Science Center at Houston, and Washington University Medical Center to undergo serial blood and urine sampling. Incomplete data including unavailability of urine samples precluded inclusion of 33 subjects; consequently the remaining 76 formed the analysis cohort. Approval from the Institutional Review Boards was received from the University of Pittsburgh and all participating sites.

Data Collection/Laboratory Measurements

Medical records of study participants were prospectively reviewed to retrieve hospitalization data including baseline demographic characteristics, serial renal function, daily urine volume, and severity of illness scores. The presence of sepsis was defined by international consensus criteria. Levy et al., "2001 SCCM/ESICM/ACCP/ATS/SIS International Sepsis Definitions Conference" *Crit Care Med*, 31:1250-1256 (2003). Recovery of renal function was defined by survival and dialysis independence at Day 60 post AKI. For purposes of primary analysis, partial recovery (i.e. failure to return to baseline renal function but free of dialysis) was included in the recovery group. Similarly, all deaths were included in the non-recovery group.

Fresh urine samples were obtained on Days 1, 7, and 14 post AKI Immediately upon obtaining a well-mixed 30 ml sample, a protease inhibitor tablet (Roche Diagnostics Corporation, IN, USA) was added. After processing, the sample was frozen (at −80° C.) until analyzed. Samples were assayed in duplicate, and data were analyzed using Bio-Rad Bio-Plex Manager Software (version 4.1). Urine creatinine concentrations were measured using a non-enzymatic assay (DICT-500, BioAssay Systems, CA, USA).

Example II

Proteomics Analysis

Urine collected in accordance with Example I from fourteen (14) patients with severe AKI was evaluated with an unbiased proteomics discovery platform.

Data collected from seven (7) patients that did not recover renal function after AM was compared to data collected from seven (7) patients that did recover renal function after AKI. The two groups were matched for age (e.g., +/−5 yrs) and gender.

The data presented herein show that approximately thirty (30) proteins were differentially expressed between the Recovery Group and the Non-Recovery Group. A preliminary analysis has categorized these proteins into groups including, but not limited to:

1. Ferritin, alpha and beta globin, or catalase that may be involved in providing protection from reactive oxygen species
2. Complement factor H or complement component 4 BP that may be involved in regulation of complement activation
3. Olfactomedin-4, leucine rich alpha-2 glycoprotein or ring finger protein 167 that may be involved in cell survival and proliferation.
4. Inter-alpha globulin inhibitor H4, heparan sulfate proteoglycan 2, (N-acylsphingosine aminohydrolase and saposin) that may be involved in basement membrane, matrix proteins or sphingolipid turnover.

Although it is not necessary to understand the mechanism of an invention, it is believed that the differential expression of proteins categorized in Group 3 and Group 4 might be directly involved in renal recovery because of their involvement with cell proliferation and/or rebuilding of the basement membrane.

LENGTHY TABLES

The patent contains a lengthy table section. A copy of the table is available in electronic form from the USPTO web site (http://seqdata.uspto.gov/?pageRequest=docDetail&DocID=US09551720B2). An electronic copy of the table will also be available from the USPTO upon request and payment of the fee set forth in 37 CFR 1.19(b)(3).

SEQUENCE LISTING (1731 sequences)

SEQ ID NO: 1 - protein, 12 aa, Homo sapiens
EFTPPVQAAYQK

SEQ ID NO: 2 - protein, 18 aa, Homo sapiens
FESFGDLSTPDAVMGNPK

SEQ ID NO: 3 - protein, 19 aa, Homo sapiens
FFESFGDLSTPDAVMGNPK

SEQ ID NO: 4 - protein, 13 aa, Homo sapiens
GTFATLSELHCDK

SEQ ID NO: 5 - protein, 16 aa, Homo sapiens
LLGNVLVCVLAHHFGK

SEQ ID NO: 6 - protein, 13 aa, Homo sapiens
VNVDEVGGEALGR

SEQ ID NO: 7 - protein, 18 aa, Homo sapiens
FRLLGNVLVCVLAHHFGK

SEQ ID NO: 8 - protein, 147 aa, Homo sapiens
MVHLTPEEKSAVTALWGKVNVDEVGGEALGRLLVVYPWTQRFFESFGDLSTPDAVMGNPKVKAHGKKVLGAFSDGLAHLDNLKGTFATLSELHCDKLHVDPENFRLLGNVLVCVLAHHFGKEFTPPVQAAYQKVVAGVANALAHKYH

SEQ ID NO: 9 - protein, 12 aa, Homo sapiens
AFYVNVLNEEQR

SEQ ID NO: 10 - protein, 13 aa, Homo sapiens
DPILFPSFIHSQK

SEQ ID NO: 11 - protein, 15 aa, Homo sapiens
FSTVAGESGSADTVR

SEQ ID NO: 12 - protein, 19 aa, Homo sapiens
GPLLVQDVVFTDEMAHFDR

SEQ ID NO: 13 - protein, 22 aa, Homo sapiens
GPRGPLLVQDVVFTDEMAHFDR

SEQ ID NO: 14 - protein, 15 aa, Homo sapiens
IRDPILFPSFIHSQK

SEQ ID NO: 15 - protein, 9 aa, Homo sapiens
LFAYPDTHR

SEQ ID NO: 16 - protein, 11 aa, Homo sapiens
LSQEDPDYGIR

SEQ ID NO: 17 - protein, 16 aa, Homo sapiens
LVQDVVFTDEMAHFDR

SEQ ID NO: 18 - protein, 19 aa, Homo sapiens
NFTEVHPDYGSHIQALLDK

SEQ ID NO: 19 - protein, 24 aa, Homo sapiens
FAEVEQIAFDPSNMPPGIEASPDK

SEQ ID NO: 20 - protein, 7 aa, Homo sapiens
VFEHIGK

SEQ ID NO: 21 - protein, 13 aa, Homo sapiens
FNTANDDNVTQVR

SEQ ID NO: 22 - protein, 527 aa, Homo sapiens
MADSRDPASDQMQHWKEQRAAQKADVLTTGAGNPVGDKLNVITVGPRGPLLVQDVVFTDEMAHFDRERIPERVVHAKGAGAFGYFEVTHDITKYSKAKVFEHIGKKTPIAVRFSTVAGESGSADTVRDPRGFAVKFYTEDGNWDLVGNNTPIFFIRDPILFPSFIHSQKRNPQTHLKDPDMVWDFWSLRPESLHQVSFLFSDRGIPDGHRHMNGYGSHTFKLVNANGEAVYCKFHYKTDQGIKNLSVEDAARLSQEDPDYGIRDLFNAIATGKYPSWTFYIQVMTFNQAETFPFNPFDLTKVWPHKDYPLIPVGKLVLNRNPVNYFAEVEQIAFDPSNMPPGIEASPDKMLQGRLFAYPDTHRHRLGPNYLHIPVNCPYRARVANYQRDGPMCMQDNQGGAPNYYPNSFGAPEQQPSALEHSIQYSGEVRRFNTANDDNVTQVRAFYVNVLNEEQRKRLCENIAGHLKDAQIFIQKKAVKNFTEVHPDYGSHIQALLDKYNAEKPKNAIHTFVQSGSHLAAREKANL

SEQ ID NO: 23 - protein, 16 aa, Homo sapiens
GLSDGEWQLVLNVWGK

SEQ ID NO: 24 - protein, 14 aa, Homo sapiens
HGATVLTALGGILK

SEQ ID NO: 25 - protein, 15 aa, Homo sapiens
VEADIPGHGQEVLIR

SEQ ID NO: 26 - protein, 18 aa, Homo sapiens
AAHLPAEFTPAVHASLDK

SEQ ID NO: 27 - protein, 12 aa, Homo sapiens
ALSALSDLHAHK

SEQ ID NO: 28 - protein, 8 aa, Homo sapiens
FLSFPTTK

SEQ ID NO: 29 - protein, 14 aa, Homo sapiens
FPHFDLSHGSAQVK

SEQ ID NO: 30 - protein, 9 aa, Homo sapiens
MFLSFPTTK

SEQ ID NO: 31 - protein, 16 aa, Homo sapiens
TYFPHFDLSHGSAQVK

SEQ ID NO: 32 - protein, 19 aa, Homo sapiens
VADALTNAVAHVDDMPNAL

SEQ ID NO: 33 - protein, 28 aa, Homo sapiens
VADALTNAVAHVDDMPNALSALSDLHAH

SEQ ID NO: 34 - protein, 18 aa, Homo sapiens
VDDMPNALSALSDLHAHK

SEQ ID NO: 35 - protein, 15 aa, Homo sapiens
VGAHAGEYGAEALER

SEQ ID NO: 36 - protein, 29 aa, Homo sapiens
VADALTNAVAHVDDMPNALSALSDLHAHK

SEQ ID NO: 37 - protein, 7 aa, Homo sapiens
VDPVNFK

SEQ ID NO: 38 - protein, 9 aa, Homo sapiens
DYFMPCPGR

SEQ ID NO: 39 - protein, 12 aa, Homo sapiens
EWFWDLATGTMK

SEQ ID NO: 40 - protein, 11 aa, Homo sapiens
FDPVRGEVPPR

SEQ ID NO: 41 - protein, 17 aa, Homo sapiens
FQGDREWFWDLATGTMK

SEQ ID NO: 42 - protein, 21 aa, Homo sapiens
LLQDEFPGIPSPLDAAVECHR

SEQ ID NO: 43 - protein, 11 aa, Homo sapiens
NFPSPVDAAFR

SEQ ID NO: 44 - protein, 8 aa, Homo sapiens
RLWWLDLK

SEQ ID NO: 45 - protein, 16 aa, Homo sapiens
SGAQATWTELPWPHEK

SEQ ID NO: 46 - protein, 15 aa, Homo sapiens
VAEGETKPDPDVTER

SEQ ID NO: 47 - protein, 11 aa, Homo sapiens
YYCFQGNQFLR

SEQ ID NO: 48 - protein, 18 aa, Homo sapiens
GIILDSVDAAFICPGSSR

SEQ ID NO: 49 - protein, 7 aa, Homo sapiens
LWWLDLK

SEQ ID NO: 50 - protein, 462 aa, Homo sapiens
MARVLGAPVALGLWSLCWSLAIATPLPPTSAHGNVAEGETKPDPDVTERCSDGWSFDATTLDDNGTMLFFKGEFVWKSHKWDRELISERWKNFPSPVDAAFRQGHNSVFLIKGDKVWVYPPEKKEKGYPKLLQDEFPGIPSPLDAAVECHRGECQAEGVLFFQGDREWFWDLATGTMKERSWPAVGNCSSALRWLGRYYCFQGNQFLRFDPVRGEVPPRYPRDVRDYFMPCPGRGHGHRNGTGHGNSTHHGPEYMRCSPHLVLSALTSDNHGATYAFSGTHYWRLDTSRDGWHSWPIAHQWPQGPSAVDAAFSWEEKLYLVQGTQVYVFLTKGGYTLVSGYPKRLEKEVGTPHGIILDSVDAAFICPGSSRLHIMAGRRLWWLDLKSGAQATWTELPWPHEKVDGALCMEKSLGPNSCSANGPGLYLIHGPNLYCYSDVEKLNAAKALPQPQNVTSLLGCTH

SEQ ID NO: 51 - protein, 16 aa, Homo sapiens
DTEEEDFHVDQVTTVK

SEQ ID NO: 52 - protein, 13 aa, Homo sapiens
DTVFALVNYIFFK

SEQ ID NO: 53 - protein, 17 aa, Homo sapiens
ELDRDTVFALVNYIFFK

SEQ ID NO: 54 - protein, 22 aa, Homo sapiens
GTEAAGAMFLEAIPMSIPPEVK

SEQ ID NO: 55 - protein, 14 aa, Homo sapiens
ITPNLAEFAFSLYR

SEQ ID NO: 56 - protein, 10 aa, Homo sapiens
KLSSWVLLMK

SEQ ID NO: 57 - protein, 9 aa, Homo sapiens
KQINDYVEK

SEQ ID NO: 58 - protein, 10 aa, Homo sapiens
LAEFAFSLYR

SEQ ID NO: 59 - protein, 10 aa, Homo sapiens
LGMFNIQHCK

SEQ ID NO: 60 - protein, 15 aa, Homo sapiens
LQHLENELTHDIITK

SEQ ID NO: 61 - protein, 10 aa, Homo sapiens
LVDKFLEDVK

SEQ ID NO: 62 - protein, 8 aa, Homo sapiens
QINDYVEK

SEQ ID NO: 63 - protein, 8 aa, Homo sapiens
SASLHLPK

SEQ ID NO: 64 - protein, 10 aa, Homo sapiens
SVLGQLGITK

SEQ ID NO: 65 - protein, 24 aa, Homo sapiens
TLNQPDSQLQLTTGNGLFLSEGLK

SEQ ID NO: 66 - protein, 12 aa, Homo sapiens
TVNFGDTEEAKK

SEQ ID NO: 67 - protein, 18 aa, Homo sapiens
VFSNGADLSGVTEEAPLK

SEQ ID NO: 68 - protein, 8 aa, Homo sapiens
WERPFEVK

SEQ ID NO: 69 - protein, 11 aa, Homo sapiens
LVDKFLEDVKK

SEQ ID NO: 70 - protein, 10 aa, Homo sapiens
GKWERPFEVK

SEQ ID NO: 71 - protein, 8 aa, Homo sapiens
AVLTIDEK

SEQ ID NO: 72 - protein, 7 aa, Homo sapiens
FLEDVKK

SEQ ID NO: 73 - protein, 10 aa, Homo sapiens
LSITGTYDLK

SEQ ID NO: 74 - protein, 6 aa, Homo sapiens
FLEDVK

SEQ ID NO: 75 - protein, 14 aa, Homo sapiens
EEEDFHVDQVTTVK

SEQ ID NO: 76 - protein, 9 aa, Homo sapiens
GLFLSEGLK

SEQ ID NO: 77 - protein, 7 aa, Homo sapiens
FNKPFVF

SEQ ID NO: 78 - protein, 11 aa, Homo sapiens
DISEMFLQIYK

SEQ ID NO: 79 - protein, 11 aa, Homo sapiens
HDVETQFNQYK

SEQ ID NO: 80 - protein, 12 aa, Homo sapiens
KNYGQLDIFPAR

SEQ ID NO: 81 - protein, 11 aa, Homo sapiens
NYGQLDIFPAR

SEQ ID NO: 82 - protein, 11 aa, Homo sapiens
QGGFLGLSNIK

SEQ ID NO: 83 - protein, 17 aa, Homo sapiens
EGTINVHDVETQFNQYK

SEQ ID NO: 84 - protein, 19 aa, Homo sapiens
AVLDVFEEGTEASAATAVK

SEQ ID NO: 85 - protein, 20 aa, Homo sapiens
DYNLNDILLQLGIEEAFTSK

SEQ ID NO: 86 - protein, 9 aa, Homo sapiens
EIGELYLPK

SEQ ID NO: 87 - protein, 18 aa, Homo sapiens
HPNSPLDEENLTQENQDR

SEQ ID NO: 88 - protein, 11 aa, Homo sapiens
ITLLSALVETR

SEQ ID NO: 89 - protein, 8 aa, Homo sapiens
KLINDYVK

SEQ ID NO: 90 - protein, 18 aa, Homo sapiens
LYGSEAFATDFQDSAAAK

SEQ ID NO: 91 - protein, 14 aa, Homo sapiens
MEEVEAMLLPETLK

SEQ ID NO: 92 - protein, 15 aa, Homo sapiens
MEEVEAMLLPETLKR

SEQ ID NO: 93 - protein, 10 aa, Homo sapiens
NLAVSQVVHK

SEQ ID NO: 94 - protein, 16 aa, Homo sapiens
NSPLDEENLTQENQDR

SEQ ID NO: 95 - protein, 15 aa, Homo sapiens
SPLDEENLTQENQDR

SEQ ID NO: 96 - protein, 14 aa, Homo sapiens
WEMPFDPQDTHQSR

SEQ ID NO: 97 - protein, 8 aa, Homo sapiens
WRDSLEFR

SEQ ID NO: 98 - protein, 14 aa, Homo sapiens
EQLSLLDRFTEDAK

SEQ ID NO: 99 - protein, 423 aa, Homo sapiens
MERMLPLLALGLLAAGFCPAVLCHPNSPLDEENLTQENQDRGTHVDLGLASANVDFAFSLYKQLVLKAPDKNVIFSPLSISTALAFLSLGAHNTTLTEILKGLKFNLTETSEAEIHQSFQHLLRTLNQSSDELQLSMGNAMFVKEQLSLLDRFTEDAKRLYGSEAFATDFQDSAAAKKLINDYVKNGTRGKITDLIKDLDSQTMMVLVNYIFFKAKWEMPFDPQDTHQSRFYLSKKKWVMVPMMSLHHLTIPYFRDEELSCTVVELKYTGNASALFILPDQDKMEEVEAMLLPETLKRWRDSLEFREIGELYLPKFSISRDYNLNDILLQLGIEEAFTSKADLSGITGARNLAVSQVVHKAVLDVFEEGTEASAATAVKITLLSALVETRTIVRFNRPFLMIIVPTDTQNIFFMSKVTNPKQA

SEQ ID NO: 100 - protein, 19 aa, Homo sapiens
AFPALTSLDLSDNPGLGER

SEQ ID NO: 101 - protein, 10 aa, Homo sapiens
GLMAALCPHK

SEQ ID NO: 102 - protein, 17 aa, Homo sapiens
GLMAALCPHKFPAIQNL

SEQ ID NO: 103 - protein, 20 aa, Homo sapiens
GLMAALCPHKFPAIQNLALR

SEQ ID NO: 104 - protein, 21 aa, Homo sapiens
ITGTMPPLPLEATGLALSSLR

SEQ ID NO: 105 - protein, 18 aa, Homo sapiens
LTVGAAQVPAQLLVGALR

SEQ ID NO: 106 - protein, 15 aa, Homo sapiens
SWLAELQQWLKPGLK

SEQ ID NO: 107 - protein, 14 aa, Homo sapiens
TTPEPCELDDEDFR

SEQ ID NO: 108 - protein, 18 aa, Homo sapiens
VLSIAQAHSPAFSCEQVR

SEQ ID NO: 109 - protein, 28 aa, Homo sapiens
AAEAAAAPAESAAPAAGEEPSKEEGEPK

SEQ ID NO: 110 - protein, 24 aa, Homo sapiens
AEPPKAPEQEQAAPGPAAGGEAPK

SEQ ID NO: 111 - protein, 19 aa, Homo sapiens
APEQEQAAPGPAAGGEAPK

SEQ ID NO: 112 - protein, 28 aa, Homo sapiens
AQGPAASAEEPKPVEAPAANSDQTVTVK

SEQ ID NO: 113 - protein, 10 aa, Homo sapiens
EKPDQDAEGK

SEQ ID NO: 114 - protein, 227 aa, Homo sapiens
MGGKLSKKKKGYNVNDEKAKEKDKKAEGAATEEEGTPKESEPQAAAEPAEAKEGKEKPDQDAEGKAEEKEGEKDAAAAKEEAPKAEPEKTEGAAEAKAEPPKAPEQEQAAPGPAAGGEAPKAAEAAAAPAESAAPAAGEEPSKEEGEPKKTEAPAAPAAQETKSDGAPASDSKPGSSEAAPSSKETPAATEAPSSTPKAQGPAASAEEPKPVEAPAANSDQTVTVKE

SEQ ID NO: 115 - protein, 13 aa, Homo sapiens
AVGFGGDFDGVPR

SEQ ID NO: 116 - protein, 22 aa, Homo sapiens
DSPVIDGHNDLPWQLLDMFNNR

SEQ ID NO: 117 - protein, 20 aa, Homo sapiens
VPEGLEDVSKYPDLIAELLR

SEQ ID NO: 118 - protein, 10 aa, Homo sapiens
YPDLIAELLR

SEQ ID NO: 119 - protein, 21 aa, Homo sapiens
VASLIGVEGGHSIDSSLGVLR

SEQ ID NO: 120 - protein, 22 aa, Homo sapiens
AVEENQESTPVVIQQETTGTPR

SEQ ID NO: 121 - protein, 18 aa, Homo sapiens
EESPLLIGQQSTVSDVPR

SEQ ID NO: 122 - protein, 20 aa, Homo sapiens
ESVPISDTIIPAVPPPTDLR

SEQ ID NO: 123 - protein, 12 aa, Homo sapiens
LISWDAPAVTVR

SEQ ID NO: 124 - protein, 15 aa, Homo sapiens
QVDAVPANGQTPIQR

SEQ ID NO: 125 - protein, 19 aa, Homo sapiens
SSPVVIDASTAIDAPSNLR

SEQ ID NO: 126 - protein, 22 aa, Homo sapiens
TETITGFQVDAVPANGQTPIQR

SEQ ID NO: 127 - protein, 15 aa, Homo sapiens
VDVIPVNLPGEHGQR

SEQ ID NO: 128 - protein, 17 aa, Homo sapiens
VTWAPPPSIDLTNFLVR

SEQ ID NO: 129 - protein, 24 aa, Homo sapiens
DLEVVAATPTSLLISWDAPAVTVR

SEQ ID NO: 130 - protein, 17 aa, Homo sapiens
IISCHPVGTDEEPLQFR

SEQ ID NO: 131 - protein, 2296 aa, Homo sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDPTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTTIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTDELPQLVTLPHPNLHGPEILDVPSTVQKTPFVTHPGYDTGNGIQLPGTSGQQPSVGQQMIFEEHGFRRTTPPTTATPIRHRPRPYPPNVGEEIQIGHIPREDVDYHLYPHGPGLNPNASTGQEALSQTTISWAPFQDTSEYIISCHPVGTDEEPLQFRVPGTSTSATLTGLTRGATYNIIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 132 - protein, 14 aa, Homo sapiens
AAMVGMLANFLGFR

SEQ ID NO: 133 - protein, 24 aa, Homo sapiens
ADSQAQLLLSTVVGVFTAPGLHLK

SEQ ID NO: 134 - protein, 12 aa, Homo sapiens
ALQDQLVLVAAK

SEQ ID NO: 135 - protein, 12 aa, Homo sapiens
DPTFIPAPIQAK

SEQ ID NO: 136 - protein, 9 aa, Homo sapiens
FMQAVTGWK

SEQ ID NO: 137 - protein, 17 aa, Homo sapiens
QPFVQGLALYTPVVLPR

SEQ ID NO: 138 - protein, 17 aa, Homo sapiens
VGEVLNSIFFELEADER

SEQ ID NO: 139 - protein, 17 aa, Homo sapiens
VLSALQAVQGLLVAQGR

SEQ ID NO: 140 - protein, 10 aa, Homo sapiens
DRVYIHPFHL

SEQ ID NO: 141 - protein, 10 aa, Homo sapiens
LQAILGVPWK

SEQ ID NO: 142 - protein, 485 aa, Homo sapiens
MRKRAPQSEMAPAGVSLRATILCLLAWAGLAAGDRVYIHPFHLVIHNESTCEQLAKANAGKPKDPTFIPAPIQAKTSPVDEKALQDQLVLVAAKLDTEDKLRAAMVGMLANFLGFRIYGMHSELWGVVHGATVLSPTAVFGTLASLYLGALDHTADRLQAILGVPWKDKNCTSRLDAHKVLSALQAVQGLLVAQGRADSQAQLLLSTVVGVFTAPGLHLKQPFVQGLALYTPVVLPRSLDFTELDVAAEKIDRFMQAVTGWKTGCSLMGASVDSTLAFNTYVHFQGKMKGFSLLAEPQEFWVDNSTSVSVPMLSGMGTFQHWSDIQDNFSVTQVPFTESACLLLIQPHYASDLDKVEGLTFQQNSLNWMKKLSPRTIHLTMPQLVLQGSYDLQDLLAQAELPAILHTELNLQKLSNDRIRVGEVLNSIFFELEADEREPTESTQQLNKPEVLEVTLNRPFLFAVYDQSATALHFLGRVANPLSTA

SEQ ID NO: 143 - protein, 10 aa, Homo sapiens
CAEENCFIQK

SEQ ID NO: 144 - protein, 19 aa, Homo sapiens
DAPDHQELNLDVSLQLPSR

SEQ ID NO: 145 - protein, 10 aa, Homo sapiens
DFDFVPPVVR

SEQ ID NO: 146 - protein, 20 aa, Homo sapiens
DTWVEHWPEEDECQDEENQK

SEQ ID NO: 147 - protein, 20 aa, Homo sapiens
EDIPPADLSDQVPDTESETR

SEQ ID NO: 148 - protein, 22 aa, Homo sapiens
EPGQDLVVLPLSITTDFIPSFR

SEQ ID NO: 149 - protein, 16 aa, Homo sapiens
EYVLPSFEVIVEPTEK

SEQ ID NO: 150 - protein, 10 aa, Homo sapiens
FYHPEKEDGK

SEQ ID NO: 151 - protein, 10 aa, Homo sapiens
HQQTVTIPPK

SEQ ID NO: 152 - protein, 10 aa, Homo sapiens
IHWESASLLR

SEQ ID NO: 153 - protein, 20 aa, Homo sapiens
ILLQGTPVAQMTEDAVDAER

SEQ ID NO: 154 - protein, 14 aa, Homo sapiens
IPIEDGSGEVVLSR

SEQ ID NO: 155 - protein, 7 aa, Homo sapiens
IWDVVEK

SEQ ID NO: 156 - protein, 12 aa, Homo sapiens
KQELSEAEQATR

SEQ ID NO: 157 - protein, 30 aa, Homo sapiens
LESEETMVLEAHDAQGDVPVTVTVHDFPGK

SEQ ID NO: 158 - protein, 7 aa, Homo sapiens
LMNIFLK

SEQ ID NO: 159 - protein, 23 aa, Homo sapiens
QKPDGVFQEDAPVIHQEMIGGLR

SEQ ID NO: 160 - protein, 18 aa, Homo sapiens
SGQSEDRQPVPGQQMTLK

SEQ ID NO: 161 - protein, 11 aa, Homo sapiens
SITTDFIPSFR

SEQ ID NO: 162 - protein, 16 aa, Homo sapiens
SNLDEDIIAEENIVSR

SEQ ID NO: 163 - protein, 14 aa, Homo sapiens
SWDIPELVNMGQWK

SEQ ID NO: 164 - protein, 13 aa, Homo sapiens
TELRPGETLNVNF

SEQ ID NO: 165 - protein, 16 aa, Homo sapiens
TELRPGETLNVNFLLR

SEQ ID NO: 166 - protein, 15 aa, Homo sapiens
TVMVNIENPEGIPVK

SEQ ID NO: 167 - protein, 13 aa, Homo sapiens
VFVTNPDGSPAYR

SEQ ID NO: 168 - protein, 11 aa, Homo sapiens
VIFGIQDGEQR

SEQ ID NO: 169 - protein, 10 aa, Homo sapiens
VLLDGVQNPR

SEQ ID NO: 170 - protein, 19 aa, Homo sapiens
VQLSNDFDEYIMAIEQTIK

SEQ ID NO: 171 - protein, 11 aa, Homo sapiens
VTIKPAPETEK

SEQ ID NO: 172 - protein, 14 aa, Homo sapiens
AGDFLEANYMNLQR

SEQ ID NO: 173 - protein, 21 aa, Homo sapiens
GICVADPFEVTVMQDFFIDLR

SEQ ID NO: 174 - protein, 8 aa, Homo sapiens
LKGPLLNK

SEQ ID NO: 175 - protein, 8 aa, Homo sapiens
FYYIYNEK

SEQ ID NO: 176 - protein, 11 aa, Homo sapiens
QPVPGQQMTLK

SEQ ID NO: 177 - protein, 15 aa, Homo sapiens
RIPIEDGSGEVVLSR

SEQ ID NO: 178 - protein, 12 aa, Homo sapiens
VSHSEDDCLAFK

SEQ ID NO: 179 - protein, 12 aa, Homo sapiens
LSINTHPSQKPL

SEQ ID NO: 180 - protein, 15 aa, Homo sapiens
GLSSDFWGEKPNLSY

SEQ ID NO: 181 - protein, 6 aa, Homo sapiens
QIHFTK

SEQ ID NO: 182 - protein, 1663 aa, Homo sapiens
MGPTSGPSLLLLLLTHLPLALGSPMYSIITPNILRLESEETMVLEAHDAQGDVPVTVTVHDFPGKKLVLSSEKTVLTPATNHMGNVTFTIPANREFKSEKGRNKFVTVQATFGTQVVEKVVLVSLQSGYLFIQTDKTIYTPGSTVLYRIFTVNHKLLPVGRTVMVNIENPEGIPVKQDSLSSQNQLGVLPLSWDIPELVNMGQWKIRAYYENSPQQVFSTEFEVKEYVLPSFEVIVEPTEKFYYIYNEKGLEVTITARFLYGKKVEGTAFVIFGIQDGEQRISLPESLKRIPIEDGSGEVVLSRKVLLDGVQNPRAEDLVGKSLYVSATVILHSGSDMVQAERSGIPIVTSPYQIHFTKTPKYFKPGMPFDLMVFVTNPDGSPAYRVPVAVQGEDTVQSLTQGDGVAKLSINTHPSQKPLSITVRTKKQELSEAEQATRTMQALPYSTVGNSNNYLHLSVLRTELRPGETLNVNFLLRMDRAHEAKIRYYTYLIMNKGRLLKAGRQVREPGQDLVVLPLSITTDFIPSFRLVAYYTLIGASGQREVVADSVWVDVKDSCVGSLVVKSGQSEDRQPVPGQQMTLKIEGDHGARVVLVAVDKGVFVLNKKNKLTQSKIWDVVEKADIGCTPGSGKDYAGVFSDAGLTFTSSSGQQTAQRAELQCPQPAARRRRSVQLTEKRMDKVGKYPKELRKCCEDGMRENPMRFSCQRRTRFISLGEACKKVFLDCCNYITELRRQHARASHLGLARSNLDEDIIAEENIVSRSEFPESWLWNVEDLKEPPKNGISTKLMNIFLKDSITTWEILAVSMSDKKGICVADPFEVTVMQDFFIDLRLPYSVVRNEQVEIRAVLYNYRQNQELKVRVELLHNPAFCSLATTKRRHQQTVTIPPKSSLSVPYVIVPLKTGLQEVEVKAAVYHHFISDGVRKSLKVVPEGIRMNKTVAVRTLDPERLGREGVQKEDIPPADLSDQVPDTESETRILLQGTPVAQMTEDAVDAERLKHLIVTPSGCGEQNMIGMTPTVIAVHYLDETEQWEKFGLEKRQGALELIKKGYTQQLAFRQPSSAFAAFVKRAPSTWLTAYVVKVFSLAVNLIAIDSQVLCGAVKWLILEKQKPDGVFQEDAPVIHQEMIGGLRNNNEKDMALTAFVLISLQEAKDICEEQVNSLPGSITKAGDFLEANYMNLQRSYTVAIAGYALAQMGRLKGPLLNKFLTTAKDKNRWEDPGKQLYNVEATSYALLALLQLKDFDFVPPVVRWLNEQRYYGGGYGSTQATFMVFQALAQYQKDAPDHQELNLDVSLQLPSRSSKITHRIHWESASLLRSEETKENEGFTVTAEGKGQGTLSVVTMYHAKAKDQLTCNKFDLKVTIKPAPETEKRPQDAKNTMILEICTRYRGDQDATMSILDISMMTGFAPDTDDLKQLANGVDRYISKYELDKAFSDRNTLIIYLDKVSHSEDDCLAFKVHQYFNVELIQPGAVKVYAYYNLEESCTRFYHPEKEDGKLNKLCRDELCRCAEENCFIQKSDDKVTLEERLDKACEPGVDYVYKTRLVKVQLSNDFDEYIMAIEQTIKSGSDEVQVGQQRTFISPIKCREALKLEEKKHYLMWGLSSDFWGEKPNLSYIIGKDTWVEHWPEEDECQDEENQKQCQDLGAFTESMVVFGCPN

SEQ ID NO: 183 - protein, 12 aa, Homo sapiens
ADGLAVIGVLMK

SEQ ID NO: 184 - protein, 19 aa, Homo sapiens
EIINVGHSFHVNFEDNDNR

SEQ ID NO: 185 - protein, 14 aa, Homo sapiens
ESISVSSEQLAQFR

SEQ ID NO: 186 - protein, 18 aa, Homo sapiens
HDTSLKPISVSYNPATAK

SEQ ID NO: 187 - protein, 6 aa, Homo sapiens
LFQFHF

SEQ ID NO: 188 - protein, 16 aa, Homo sapiens
LYPIANGNNQSPVDIK

SEQ ID NO: 189 - protein, 8 aa, Homo sapiens
NGPEQWSK

SEQ ID NO: 190 - protein, 12 aa, Homo sapiens
SFHVNFEDNDNR

SEQ ID NO: 191 - protein, 17 aa, Homo sapiens
SLLSNVEGDNAVPMQHN

SEQ ID NO: 192 - protein, 9 aa, Homo sapiens
VLDALQAIK

SEQ ID NO: 193 - protein, 10 aa, Homo sapiens
YSAELHVAHW

SEQ ID NO: 194 - protein, 14 aa, Homo sapiens
YSAELHVAHWNSAK

SEQ ID NO: 195 - protein, 25 aa, Homo sapiens
SLLSNVEGDNAVPMQHNNRPTQPLK

SEQ ID NO: 196 - protein, 9 aa, Homo sapiens
ACSYPLDMK

SEQ ID NO: 197 - protein, 16 aa, Homo sapiens
DSTIQVVENGESSQGR

SEQ ID NO: 198 - protein, 10 aa, Homo sapiens
DWVSVVTPAR

SEQ ID NO: 199 - protein, 7 aa, Homo sapiens
FSVQMFR

SEQ ID NO: 200 - protein, 12 aa, Homo sapiens
INFACSYPLDMK

SEQ ID NO: 201 - protein, 8 aa, Homo sapiens
LADEIIIR

SEQ ID NO: 202 - protein, 9 aa, Homo sapiens
LECGANDMK

SEQ ID NO: 203 - protein, 22 aa, Homo sapiens
LSPGLGCTDVDECAEPGLSHCH

SEQ ID NO: 204 - protein, 14 aa, Homo sapiens
LYVGTMLDGGDLSR

SEQ ID NO: 205 - protein, 10 aa, Homo sapiens
MAETCVPVLR

SEQ ID NO: 206 - protein, 9 aa, Homo sapiens
SCVCPEGFR

SEQ ID NO: 207 - protein, 13 aa, Homo sapiens
SNTLYLADEIIIR

SEQ ID NO: 208 - protein, 15 aa, Homo sapiens
STEYGEGYACDTDLR

SEQ ID NO: 209 - protein, 13 aa, Homo sapiens
TALQPMVSALNIR

SEQ ID NO: 210 - protein, 7 aa, Homo sapiens
TLDEYWR

SEQ ID NO: 211 - protein, 9 aa, Homo sapiens
VFMYLSDSR

SEQ ID NO: 212 - protein, 12 aa, Homo sapiens
VGTMLDGGDLSR

SEQ ID NO: 213 - protein, 9 aa, Homo sapiens
VLNLGPITR

SEQ ID NO: 214 - protein, 6 aa, Homo sapiens
WHCQCK

SEQ ID NO: 215 - protein, 7 aa, Homo sapiens
YFIIQDR

SEQ ID NO: 216 - protein, 15 aa, Homo sapiens
SLGFDKVFMYLSDSR

SEQ ID NO: 217 - protein, 6 aa, Homo sapiens
SLGFDK

SEQ ID NO: 218 - protein, 7 aa, Homo sapiens
SYPLDMK

SEQ ID NO: 219 - protein, 7 aa, Homo sapiens
CSGFNDR

SEQ ID NO: 220 - protein, 5 aa, Homo sapiens
DLNIK

SEQ ID NO: 221 - protein, 15 aa, Homo sapiens
DFISLGLQDGHLVFR

SEQ ID NO: 222 - protein, 14 aa, Homo sapiens
FHDDGFLAFPGHVF

SEQ ID NO: 223 - protein, 16 aa, Homo sapiens
FHDDGFLAFPGHVFSR

SEQ ID NO: 224 - protein, 14 aa, Homo sapiens
GSIQVDGEELVSGR

SEQ ID NO: 225 - protein, 18 aa, Homo sapiens
GSVYIGGAPDVATLTGGR

SEQ ID NO: 226 - protein, 14 aa, Homo sapiens
LVSEDPINDGEWHR

SEQ ID NO: 227 - protein, 14 aa, Homo sapiens
PGAPPPQPLDLQHR

SEQ ID NO: 228 - protein, 14 aa, Homo sapiens
SLPEVPETIELEVR

SEQ ID NO: 229 - protein, 14 aa, Homo sapiens
IGGAPDVATLTGGR

SEQ ID NO: 230 - protein, 4391 aa, Homo sapiens
MGWRAAGALLLALLLHGRLLAVTHGLRAYDGLSLPEDIETVTASQMRWTHSYLSDDEDMLADSISGDDLGSGDLGSGDFQMVYFRALVNFTRSIEYSPQLEDAGSREFREVSEAVVDTLESEYLKIPGDQVVSVVFIKELDGWVFVELDVGSEGNADGAQIQEMLLRVISSGSVASYVTSPQGFQFRRLGTVPQFPRACTEAEFACHSYNECVALEYRCDRRPDCRDMSDELNCEEPVLGISPTFSLLVETTSLPPRPETTIMRQPPVTHAPQPLLPGSVRPLPCGPQEAACRNGHCIPRDYLCDGQEDCEDGSDELDCGPPPPCEPNEFPCGNGHCALKLWRCDGDFDCEDRTDEANCPTKRPEEVCGPTQFRCVSTNMCIPASFHCDEESDCPDRSDEFGCMPPQVVTPPRESIQASRGQTVTFTCVAIGVPTPIINWRLNWGHIPSHPRVTVTSEGGRGTLIIRDVKESDQGAYTCEAMNARGMVFGIPDGVLELVPQRGPCPDGHFYLEHSAACLPCFCFGITSVCQSTRRFRDQIRLRFDQPDDFKGVNVTMPAQPGTPPLSSTQLQIDPSLHEFQLVDLSRRFLVHDSFWALPEQFLGNKVDSYGGSLRYNVRYELARGMLEPVQRPDVVLMGAGYRLLSRGHTPTQPGALNQRQVQFSEEHWVHESGRPVQRAELLQVLQSLEAVLIQTVYNTKMASVGLSDIAMDTTVTHATSHGRAHSVEECRCPIGYSGLSCESCDAHFTRVPGGPYLGTCSGCNCNGHASSCDPVYGHCLNCQHNTEGPQCNKCKAGFFGDAMKATATSCRPCPCPYIDASRRFSDTCFLDTDGQATCDACAPGYTGRRCESCAPGYEGNPIQPGGKCRPVNQEIVRCDERGSMGTSGEACRCKNNVVGRLCNECADGSFHLSTRNPDGCLKCFCMGVSRHCTSSSWSRAQLHGASEEPGHFSLTNAASTHTTNEGIFSPTPGELGFSSFHRLLSGPYFWSLPSRFLGDKVTSYGGELRFTVTQRSQPGSTPLHGQPLVVLQGNNIILEHHVAQEPSPGQPSTFIVPFREQAWQRPDGQPATREHLLMALAGIDTLLIRASYAQQPAESRVSGISMDVAVPEETGQDPALEVEQCSCPPGYRGPSCQDCDTGYTRTPSGLYLGTCERCSCHGHSEACEPETGACQGCQHHTEGPRCEQCQPGYYGDAQRGTPQDCQLCPCYGDPAAGQAAHTCFLDTDGHPTCDACSPGHSGRHCERCAPGYYGNPSQGQPCQRDSQVPGPIGCNCDPQGSVSSQCDAAGQCQCKAQVEGLTCSHCRPHHFHLSASNPDGCLPCFCMGITQQCASSAYTRHLISTHFAPGDFQGFALVNPQRNSRLTGEFTVEPVPEGAQLSFGNFAQLGHESFYWQLPETYQGDKVAAYGGKLRYTLSYTAGPQGSPLSDPDVQITGNNIMLVASQPALQGPERRSYEIMFREEFWRRPDGQPATREHLLMALADLDELLIRATFSSVPLAASISAVSLEVAQPGPSNRPRALEVEECRCPPGYIGLSCQDCAPGYTRTGSGLYLGHCELCECNGHSDLCHPETGACSQCQHNAAGEFCELCAPGYYGDATAGTPEDCQPCACPLTNPENMFSRTCESLGAGGYRCTACEPGYTGQYCEQCGPGYVGNPSVQGGQCLPETNQAPLVVEVHPARSIVPQGGSHSLRCQVSGSPPHYFYWSREDGRPVPSGTQQRHQGSELHFPSVQPSDAGVYICTCRNLHQSNTSRAELLVTEAPSKPITVTVEEQRSQSVRPGADVTFICTAKSKSPAYTLVWTRLHNGKLPTRAMDFNGILTIRNVQLSDAGTYVCTGSNMFAMDQGTATLHVQASGTLSAPVVSIHPPQLTVQPGQLAEFRCSATGSPTPTLEWTGGPGGQLPAKAQIHGGILRLPAVEPTDQAQYLCRAHSSAGQQVARAVLHVHGGGGPRVQVSPERTQVHAGRTVRLYCRAAGVPSATITWRKEGGSLPPQARSERTDIATLLIPAITTADAGFYLCVATSPAGTAQARIQVVVLSASDASPPPVKIESSSPSVTEGQTLDLNCVVAGSAHAQVTWYRRGGSLPPHTQVHGSRLRLPQVSPADSGEYVCRVENGSGPKEASITVSVLHGTHSGPSYTPVPGSTRPIRIEPSSSHVAEGQTLDLNCVVPGQAHAQVTWHKRGGSLPARHQTHGSLLRLHQVTPADSGEYVCHVVGTSGPLEASVLVTIEASVIPGPIPPVRIESSSSTVAEGQTLDLSCVVAGQAHAQVTWYKRGGSLPARHQVRGSRLYIFQASPADAGQYVCRASNGMEASITVTVTGTQGANLAYPAGSTQPIRIEPSSSQVAEGQTLDLNCVVPGQSHAQVTWHKRGGSLPVRHQTHGSLLRLYQASPADSGEYVCRVLGSSVPLEASVLVTIEPAGSVPALGVTPTVRIESSSSQVAEGQTLDLNCLVAGQAHAQVTWHKRGGSLPARHQVHGSRLRLLQVTPADSGEYVCRVVGSSGTQEASVLVTIQQRLSGSHSQGVAYPVRIESSSASLANGHTLDLNCLVASQAPHTITWYKRGGSLPSRHQIVGSRLRIPQVTPADSGEYVCHVSNGAGSRETSLIVTIQGSGSSHVPSVSPPIRIESSSPTVVEGQTLDLNCVVARQPQAIITWYKRGGSLPSRHQTHGSHLRLHQMSVADSGEYVCRANNNIDALEASIVISVSPSAGSPSAPGSSMPIRIESSSSHVAEGETLDLNCVVPGQAHAQVTWHKRGGSLPSHHQTRGSRLRLHHVSPADSGEYVCRVMGSSGPLEASVLVTIEASGSSAVHVPAPGGAPPIRIEPSSSRVAEGQTLDLKCVVPGQAHAQVTWHKRGGNLPARHQVHGPLLRLNQVSPADSGEYSCQVTGSSGTLEASVLVTIEPSSPGPIPAPGLAQPIYIEASSSHVTEGQTLDLNCVVPGQAHAQVTWYKRGGSLPARHQTHGSQLRLHLVSPADSGEYVCRAASGPGPEQEASFTVTVPPSEGSSYRLRSPVISIDPPSSTVQQGQDASFKCLIHDGAAPISLEWKTRNQELEDNVHISPNGSIITIVGTRPSNHGTYRCVASNAYGVAQSVVNLSVHGPPTVSVLPEGPVWVKVGKAVTLECVSAGEPRSSARWTRISSTPAKLEQRTYGLMDSHAVLQISSAKPSDAGTYVCLAQNALGTAQKQVEVIVDTGAMAPGAPQVQAEEAELTVEAGHTATLRCSATGSPAPTIHWSKLRSPLPWQHRLEGDTLIIPRVAQQDSGQYICNATSPAGHAEATIILHVESPPYATTVPEHASVQAGETVQLQCLAHGTPPLTFQWSRVGSSLPGRATARNELLHFERAAPEDSGRYRCRVTNKVGSAEAFAQLLVQGPPGSLPATSIPAGSTPTVQVTPQLETKSIGASVEFHCAVPSDRGTQLRWFKEGGQLPPGHSVQDGVLRIQNLDQSCQGTYICQAHGPWGKAQASAQLVIQALPSVLINIRTSVQTVVVGHAVEFECLALGDPKPQVTWSKVGGHLRPGIVQSGGVVRIAHVELADAGQYRCTATNAAGTTQSHVLLLVQALPQISMPQEVRVPAGSAAVFPCIASGYPTPDISWSKLDGSLPPDSRLENNMLMLPSVRPQDAGTYVCTATNRQGKVKAFAHLQVPERVVPYFTQTPYSFLPLPTIKDAYRKFEIKITFRPDSADGMLLYNGQKRVPGSPTNLANRQPDFISFGLVGGRPEFRFDAGSGMATIRHPTPLALGHFHTVTLLRSLTQGSLIVGDLAPVNGTSQGKFQGLDLNEELYLGGYPDYGAIPKAGLSSGFIGCVRELRIQGEEIVFHDLNLTAHGISHCPTCRDRPCQNGGQCHDSESSSYVCVCPAGFTGSRCEHSQALHCHPEACGPDATCVNRPDGRGYTCRCHLGRSGLRCEEGVTVTTPSLSGAGSYLALPALTNTHHELRLDVEFKPLAPDGVLLFSGGKSGPVEDFVSLAMVGGHLEFRYELGSGLAVLRSAEPLALGRWHRVSAERLNKDGSLRVNGGRPVLRSSPGKSQGLNLHTLLYLGGVEPSVPLSPATNMSAHFRGCVGEVSVNGKRLDLTYSFLGSQGIGQCYDSSPCERQPCQHGATCMPAGEYEFQCLCRDGFKGDLCEHEENPCQLREPCLHGGTCQGTRCLCLPGFSGPRCQQGSGHGIAESDWHLEGSGGNDAPGQYGAYFHDDGFLAFPGHVFSRSLPEVPETIELEVRTSTASGLLLWQGVEVGEAGQGKDFISLGLQDGHLVFRYQLGSGEARLVSEDPINDGEWHRVTALREGRRGSIQVDGEELVSGRSPGPNVAVNAKGSVYIGGAPDVATLTGGRFSSGITGCVKNLVLHSARPGAPPPQPLDLQHRAQAGANTRPCPS

SEQ ID NO: 231 - protein, 12 aa, Homo sapiens
ASSIIDELFQDR

SEQ ID NO: 232 - protein, 13 aa, Homo sapiens
ASSIIDELFQDRF

SEQ ID NO: 233 - protein, 16 aa, Homo sapiens
EILSVDCSTNNPSQAK

SEQ ID NO: 234 - protein, 11 aa, Homo sapiens
ELDESLQVAER

SEQ ID NO: 235 - protein, 17 aa, Homo sapiens
LFDSDPITVTVPVEVSR

SEQ ID NO: 236 - protein, 9 aa, Homo sapiens
MLDVMQDHF

SEQ ID NO: 237 - protein, 12 aa, Homo sapiens
PITVTVPVEVSR

SEQ ID NO: 238 - protein, 23 aa, Homo sapiens
VTTVASHTSDSDVPSGVTEVVVK

SEQ ID NO: 239 - protein, 8 aa, Homo sapiens
RPHFFFPK

SEQ ID NO: 240 - protein, 501 aa, Homo sapiens
MQVCSQPQRGCVREQSAINTAPPSAHNAASPGGARGHRVPLTEACKDSRIGGMMKTLLLFVGLLLTWESGQVLGDQTVSDNELQEMSNQGSKYVNKEIQNAVNGVKQIKTLIEKTNEERKTLLSNLEEAKKKKEDALNETRESETKLKELPGVCNETMMALWEECKPCLKQTCMKFYARVCRSGSGLVGRQLEEFLNQSSPFYFWMNGDRIDSLLENDRQQTHMLDVMQDHFSRASSIIDELFQDRFFTREPQDTYHYLPFSLPHRRPHFFFPKSRIVRSLMPFSPYEPLNFHAMFQPFLEMIHEAQQAMDIHFHSPAFQHPPTEFIREGDDDRTVCREIRHNSTGCLRMKDQCDKCREILSVDCSTNNPSQAKLRRELDESLQVAERLTRKYNELLKSYQWKMLNTSSLLEQLNEQFNWVSRLANLTQGEDQYYLRVTTVASHTSDSDVPSGVTEVVVKLFDSDPITVTVPVEVSRKNPKFMETVAEKALQEYRKKHREE

SEQ ID NO: 241 - protein, 17 aa, Homo sapiens
FYPEDVAEELIQDITQK

SEQ ID NO: 242 - protein, 11 aa, Homo sapiens
KEDEVEEWQHR

SEQ ID NO: 243 - protein, 13 aa, Homo sapiens
QLLTLSSELSQAR

SEQ ID NO: 244 - protein, 7 aa, Homo sapiens
QQLETEK

SEQ ID NO: 245 - protein, 7 aa, Homo sapiens
GFPTWLK

SEQ ID NO: 246 - protein, 16 aa, Homo sapiens
IAQDLEMYGINYFEIK

SEQ ID NO: 247 - protein, 14 aa, Homo sapiens
ILQLCMGNHELYMR

SEQ ID NO: 248 - protein, 19 aa, Homo sapiens
FFESFGDLSSPDAVMGNPK

SEQ ID NO: 249 - protein, 13 aa, Homo sapiens
VNVDAVGGEALGR

SEQ ID NO: 250 - protein, 13 aa, Homo sapiens
GTFSQLSELHCDK

SEQ ID NO: 251 - protein, 147 aa, Homo sapiens
MVHLTPEEKTAVNALWGKVNVDAVGGEALGRLLVVYPWTQRFFESFGDLSSPDAVMGNPKVKAHGKKVLGAFSDGLAHLDNLKGTFSQLSELHCDKLHVDPENFRLLGNVLVCVLARNFGKEFTPQMQAAYQKVVAGVANALAHKYH

SEQ ID NO: 252 - protein, 14 aa, Homo sapiens
AHYGGFTVQNEANK

SEQ ID NO: 253 - protein, 15 aa, Homo sapiens
DNENVVNEYSSELEK

SEQ ID NO: 254 - protein, 12 aa, Homo sapiens
ETVNSNIPTNLR

SEQ ID NO: 255 - protein, 20 aa, Homo sapiens
GGETSEMYLIQPDSSVKPYR

SEQ ID NO: 256 - protein, 18 aa, Homo sapiens
HQLYIDETVNSNIPTNLR

SEQ ID NO: 257 - protein, 14 aa, Homo sapiens
IDETVNSNIPTNLR

SEQ ID NO: 258 - protein, 12 aa, Homo sapiens
LIQPDSSVKPYR

SEQ ID NO: 259 - protein, 14 aa, Homo sapiens
MGPTELLIEMEDWK

SEQ ID NO: 260 - protein, 15 aa, Homo sapiens
NYCGLPGEYWLGNDK

SEQ ID NO: 261 - protein, 13 aa, Homo sapiens
QGFGNVATNTDGK

SEQ ID NO: 262 - protein, 15 aa, Homo sapiens
YIDETVNSNIPTNLR

SEQ ID NO: 263 - protein, 14 aa, Homo sapiens
QGVNDNEEGFFSAR

SEQ ID NO: 264 - protein, 13 aa, Homo sapiens
LESDVSAQMEYCR

SEQ ID NO: 265 - protein, 7 aa, Homo sapiens
SILENLR

SEQ ID NO: 266 - protein, 491 aa, Homo sapiens
MKRMVSWSFHKLKTMKHLLLLLLCVFLVKSQGVNDNEEGFFSARGHRPLDKKREEAPSLRPAPPPISGGGYRARPAKAAATQKKVERKAPDAGGCLHADPDLGVLCPTGCQLQEALLQQERPIRNSVDELNNNVEAVSQTSSSSFQYMYLLKDLWQKRQKQVKDNENVVNEYSSELEKHQLYIDETVNSNIPTNLRVLRSILENLRSKIQKLESDVSAQMEYCRTPCTVSCNIPVVSGKECEEIIRKGGETSEMYLIQPDSSVKPYRVYCDMNTENGGWTVIQNRQDGSVDFGRKWDPYKQGFGNVATNTDGKNYCGLPGEYWLGNDKISQLTRMGPTELLIEMEDWKGDKVKAHYGGFTVQNEANKYQISVNKYRGTAGNALMDGASQLMGENRTMTIHNGMFFSTYDRDNDGWLTSDPRKQCSKEDGGGWWYNRCHAANPNGRYYWGGQYTWDMAKHGTDDGVVWMNWKGSWYSMRKMSMKIRPFFPQQ

SEQ ID NO: 267 - protein, 17 aa, Homo sapiens
FYPEDVSEELIQDITQR

SEQ ID NO: 268 - protein, 21 aa, Homo sapiens
GSELWLGVDALGLNIYEQNDR

SEQ ID NO: 269 - protein, 15 aa, Homo sapiens
TQEQLALEMAELTAR

SEQ ID NO: 270 - protein, 9 aa, Homo sapiens
ERQEAEEAK

SEQ ID NO: 271 - protein, 16 aa, Homo sapiens
KTQEQLALEMAELTAR

SEQ ID NO: 272 - protein, 577 aa, Homo sapiens
MPKTISVRVTTMDAELEFAIQPNTTGKQLFDQVVKTIGLREVWFFGLQYQDTKGFSTWLKLNKKVTAQDVRKESPLLFKFRAKFYPEDVSEELIQDITQRLFFLQVKEGILNDDIYCPPETAVLLASYAVQSKYGDFNKEVHKSGYLAGDKLLPQRVLEQHKLNKDQWEERIQVWHEEHRGMLREDAVLEYLKIAQDLEMYGVNYFSIKNKKGSELWLGVDALGLNIYEQNDRLTPKIGFPWSEIRNISFNDKKFVIKPIDKKAPDFVFYAPRLRINKRILALCMGNHELYMRRRKPDTIEVQQMKAQAREEKHQKQMERAMLENEKKKREMAEKEKEKIEREKEELMERLKQIEEQTKKAQQELEEQTRRALELEQERKRAQSEAEKLAKERQEAEEAKEALLQASRDQKKTQEQLALEMAELTARISQLEMARQKKESEAVEWQQKAQMVQEDLEKTRAELKTAMSTPHVAEPAENEQDEQDENGAEASADLRADAMAKDRSEEERTTEAEKNERVQKHLKALTSELANARDESKKTANDMIHAENMRLGRDKYKTLRQIRQGNTKQRIDEFESM

SEQ ID NO: 273 - protein, 13 aa, Homo sapiens
CSTSSLLEACTFR

SEQ ID NO: 274 - protein, 15 aa, Homo sapiens
DCHLAQVPSHTVVAR

SEQ ID NO: 275 - protein, 17 aa, Homo sapiens
EDLIWELLNQAQEHFGK

SEQ ID NO: 276 - protein, 16 aa, Homo sapiens
EGTCPEAPTDECKPVK

SEQ ID NO: 277 - protein, 11 aa, Homo sapiens
HQTVPQNTGGK

SEQ ID NO: 278 - protein, 11 aa, Homo sapiens
HSTIFENLANK

SEQ ID NO: 279 - protein, 13 aa, Homo sapiens
KPVEEYANCHLAR

SEQ ID NO: 280 - protein, 12 aa, Homo sapiens
MYLGYEYVTAIR

SEQ ID NO: 281 - protein, 15 aa, Homo sapiens
NIPIGLLYCDLPEPR

SEQ ID NO: 282 - protein, 16 aa, Homo sapiens
NLNEKDYELLCLDGTR

SEQ ID NO: 283 - protein, 19 aa, Homo sapiens
SAGWNIPIGLLYCDLPEPR

SEQ ID NO: 284 - protein, 8 aa, Homo sapiens
YLGEEYVK

SEQ ID NO: 285 - protein, 658 aa, Homo sapiens
MRLAVGALLVCAVLGLCLAVPDKTVRWCAVSEHEATKCQSFRDHMKSVIPSDGPSVACVKKASYLDCIRAIAANEADAVTLDAGLVYDAYLAPNNLKPVVAEFYGSKEDPQTFYYAVAVVKKDSGFQMNQLRGKKSCHTGLGRSAGWNIPIGLLYCDLPEPRKPLEKAVANFFSGSCAPCADGTDFPQLCQLCPGCGCSTLNQYFGYSGAFKCLKDGAGDVAFVKHSTIFENLANKADRDQYELLCLDNTRKPVDEYKDCHLAQVPSHTVVARSMGGKEDLIWELLNQAQEHFGKDKSKEFQLFSSPHGKDLLFKDSAHGFLKVPPRMDAKMYLGYEYVTAIRNLREGTCPEAPTDECKPVKWCALSHHERLKCDEWSVNSVGKIECVSAETTEDCIAKIMNGEADAMSLDGGFVYIAGKCGLVPVLAENYNKSDNCEDTPEAGYFAVAVVKKSASDLTWDNLKGKKSCHTAVGRTAGWNGLNLCEPNNKEGYYGYTGAFRCLVEKGDVAFVKHQTVPQNTGGKNPDPWAKNLNEKDYELLCLDGTRKPVEEYANCHLARAPNHAVVTRKDKEACVHKILRQQQHLFGSNVTDCSGNFCLFRSETKDLLFRDDTVCLAKLHDRNTYEKYLGEEYVKAVGNLRKCSTSSLLEACTFRRP

SEQ ID NO: 286 - protein, 17 aa, Homo sapiens
AIPVAQDLNAPSDWDSR

SEQ ID NO: 287 - protein, 21 aa, Homo sapiens
GKDSYETSQLDDQSAETHSHK

SEQ ID NO: 288 - protein, 20 aa, Homo sapiens
KANDESNEHSDVIDSQELSK

SEQ ID NO: 289 - protein, 6 aa, Homo sapiens
SKEEDK

SEQ ID NO: 290 - protein, 12 aa, Homo sapiens
ALVFVDNHDNQR

SEQ ID NO: 291 - protein, 19 aa, Homo sapiens
EVTINPDTTCGNDWVCEHR

SEQ ID NO: 292 - protein, 17 aa, Homo sapiens
IAEYMNHLIDIGVAGFR

SEQ ID NO: 293 - protein, 11 aa, Homo sapiens
LTGLLDLALEK

SEQ ID NO: 294 - protein, 15 aa, Homo sapiens
LTGLLDLALEKDYVR

SEQ ID NO: 295 - protein, 23 aa, Homo sapiens
NVVDGQPFTNWYDNGSNQVAFGR

SEQ ID NO: 296 - protein, 13 aa, Homo sapiens
NWGEGWGFVPSDR

SEQ ID NO: 297 - protein, 10 aa, Homo sapiens
WVDIALECER

SEQ ID NO: 298 - protein, 511 aa, Homo sapiens
MKFFLLLFTIGFCWAQYSPNTQQGRTSIVHLFEWRWVDIALECERYLAPKGFGGVQVSPPNENVAIYNPFRPWWERYQPVSYKLCTRSGNEDEFRNMVTRCNNVGVRIYVDAVINHMCGNAVSAGTSSTCGSYFNPGSRDFPAVPYSGWDFNDGKCKTGSGDIENYNDATQVRDCRLTGLLDLALEKDYVRSKIAEYMNHLIDIGVAGFRLDASKHMWPGDIKAILDKLHNLNSNWFPAGSKPFIYQEVIDLGGEPIKSSDYFGNGRVTEFKYGAKLGTVIRKWNGEKMSYLKNWGEGWGFVPSDRALVFVDNHDNQRGHGAGGASILTFWDARLYKMAVGFMLAHPYGFTRVMSSYRWPRQFQNGNDVNDWVGPPNNNGVIKEVTINPDTTCGNDWVCEHRWRQIRNMVIFRNVVDGQPFTNWYDNGSNQVAFGRGNRGFIVFNNDDWSFSLTLQTGLPAGTYCDVISGDKINGNCTGIKIYVSDDGKAHFSISNSAEDPFIAIHAESKL

SEQ ID NO: 299 - protein, 16 aa, Homo sapiens
GLGTDEDSLIEIICSR

SEQ ID NO: 300 - protein, 18 aa, Homo sapiens
RAEDGSVIDYELIDQDAR

SEQ ID NO: 301 - protein, 12 aa, Homo sapiens
SYSPYDMLESIR

SEQ ID NO: 302 - protein, 357 aa, Homo sapiens
MGRQLAGCGDAGKKASFKMSTVHEILCKLSLEGDHSTPPSAYGSVKAYTNFDAERDALNIETAIKTKGVDEVTIVNILTNRSNAQRQDIAFAYQRRTKKELASALKSALSGHLETVILGLLKTPAQYDASELKASMKGLGTDEDSLIEIICSRTNQELQEINRVYKEMYKTDLEKDIISDTSGDFRKLMVALAKGRRAEDGSVIDYELIDQDARDLYDAGVKRKGTDVPKWISIMTERSVPHLQKVFDRYKSYSPYDMLESIRKEVKGDLENAFLNLVQCIQNKPLYFADRLYDSMKGKGTRDKVLIRIMVSRSEVDMLKIRSEFKRKYGKSLYYYIQQDTKGDYQKALLYLCGGDD

SEQ ID NO: 303 - protein, 11 aa, Homo sapiens
EDVYVVGTVLR

SEQ ID NO: 304 - protein, 12 aa, Homo sapiens
LSLEIEQLELQR

SEQ ID NO: 305 - protein, 14 aa, Homo sapiens
FSAICQGDGTWSPR

SEQ ID NO: 306 - protein, 9 aa, Homo sapiens
YTCLPGYVR

SEQ ID NO: 307 - protein, 16 aa, Homo sapiens
CEWETPEGCEQVLTGK

SEQ ID NO: 308 - protein, 597 aa, Homo sapiens
MHPPKTPSGALHRKRKMAAWPFSRLWKVSDPILFQMTLIAALLPAVLGNCGPPPTLSFAAPMDITLTETRFKTGTTLKYTCLPGYVRSHSTQTLTCNSDGEWVYNTFCIYKRCRHPGELRNGQVEIKTDLSFGSQIEFSCSEGFFLIGSTTSRCEVQDRGVGWSHPLPQCEIVKCKPPPDIRNGRHSGEENFYAYGFSVTYSCDPRFSLLGHASISCTVENETIGVWRPSPPTCEKITCRKPDVSHGEMVSGFGPIYNYKDTIVFKCQKGFVLRGSSVIHCDADSKWNPSPPACEPNSCINLPDIPHASWETYPRPTKEDVYVVGTVLRYRCHPGYKPTTDEPTTVICQKNLRWTPYQGCEALCCPEPKLNNGEITQHRKSRPANHCVYFYGDEISFSCHETSRFSAICQGDGTWSPRTPSCGDICNFPPKIAHGHYKQSSSYSFFKEEIIYECDKGYILVGQAKLSCSYSHWSAPAPQCKALCRKPELVNGRLSVDKDQYVEPENVTIQCDSGYGVVGPQSITCSGNRTWYPEVPKCEWETPEGCEQVLTGKRLMQCLPNPEDVKMALEVYKLSLEIEQLELQRDSARQSTLDKEL

SEQ ID NO: 309 - protein, 12 aa, Homo sapiens
AAFTECCQAADK

SEQ ID NO: 310 - protein, 13 aa, Homo sapiens
ADDKETCFAEEGK

SEQ ID NO: 311 - protein, 14 aa, Homo sapiens
ADDKETCFAEEGKK

SEQ ID NO: 312 - protein, 8 aa, Homo sapiens
AEFAEVSK

SEQ ID NO: 313 - protein, 21 aa, Homo sapiens
ALVLIAFAQYLQQCPFEDHVK

SEQ ID NO: 314 - protein, 14 aa, Homo sapiens
AQYLQQCPFEDHVK

SEQ ID NO: 315 - protein, 12 aa, Homo sapiens
AVMDDFAAFVEK

SEQ ID NO: 316 - protein, 9 aa, Homo sapiens
CCTESLVNR

SEQ ID NO: 317 - protein, 25 aa, Homo sapiens
CIAEVENDEMPADLPSLAADFVESK

SEQ ID NO: 318 - protein, 13 aa, Homo sapiens
CTAFHDNEETFLK

SEQ ID NO: 319 - protein, 8 aa, Homo sapiens
DDNPNLPR

SEQ ID NO: 320 - protein, 8 aa, Homo sapiens
DLGEENFK

SEQ ID NO: 321 - protein, 10 aa, Homo sapiens
ECCEKPLLEK

SEQ ID NO: 322 - protein, 9 aa, Homo sapiens
ETCFAEEGK

SEQ ID NO: 323 - protein, 10 aa, Homo sapiens
ETCFAEEGKK

SEQ ID NO: 324 - protein, 12 aa, Homo sapiens
ETYGEMADCCAK

SEQ ID NO: 325 - protein, 10 aa, Homo sapiens
FKDLGEENFK

SEQ ID NO: 326 - protein, 8 aa, Homo sapiens
FQNALLVR

SEQ ID NO: 327 - protein, 13 aa, Homo sapiens
FSALEVDETYVPK

SEQ ID NO: 328 - protein, 11 aa, Homo sapiens
FYAPELLFFAK

SEQ ID NO: 329 - protein, 9 aa, Homo sapiens
HDNEETFLK

SEQ ID NO: 330 - protein, 11 aa, Homo sapiens
HPDYSVVLLLR

SEQ ID NO: 331 - protein, 24 aa, Homo sapiens
IAEVENDEMPADLPSLAADFVESK

SEQ ID NO: 332 - protein, 10 aa, Homo sapiens
KQTALVELVK

SEQ ID NO: 333 - protein, 15 aa, Homo sapiens
KVPQVSTPTLVEVSR

SEQ ID NO: 334 - protein, 8 aa, Homo sapiens
KYLYEIAR

SEQ ID NO: 335 - protein, 8 aa, Homo sapiens
LCTVATLR

SEQ ID NO: 336 - protein, 9 aa, Homo sapiens
LDELRDEGK

SEQ ID NO: 337 - protein, 12 aa, Homo sapiens
LKECCEKPLLEK

SEQ ID NO: 338 - protein, 10 aa, Homo sapiens
LVNEVTEFAK

SEQ ID NO: 339 - protein, 22 aa, Homo sapiens
LVRPEVDVMCTAFHDNEETFLK

SEQ ID NO: 340 - protein, 7 aa, Homo sapiens
LVTDLTK

SEQ ID NO: 341 - protein, 21 aa, Homo sapiens
MPCAEDYLSVVLNQLCVLHEK

SEQ ID NO: 342 - protein, 8 aa, Homo sapiens
NECFLQHK

SEQ ID NO: 343 - protein, 11 aa, Homo sapiens
PLVEEPQNLIK

SEQ ID NO: 344 - protein, 13 aa, Homo sapiens
QEPERNECFLQHK

SEQ ID NO: 345 - protein, 8 aa, Homo sapiens
QLCVLHEK

SEQ ID NO: 346 - protein, 9 aa, Homo sapiens
QTALVELVK

SEQ ID NO: 347 - protein, 16 aa, Homo sapiens
RPCFSALEVDETYVPK

SEQ ID NO: 348 - protein, 12 aa, Homo sapiens
SALEVDETYVPK

SEQ ID NO: 349 - protein, 27 aa, Homo sapiens
SHCIAEVENDEMPADLPSLAADFVESK

SEQ ID NO: 350 - protein, 9 aa, Homo sapiens
SLHTLFGDK

SEQ ID NO: 351 - protein, 12 aa, Homo sapiens
TAFHDNEETFLK

SEQ ID NO: 352 - protein, 13 aa, Homo sapiens
TCVADESAENCDK

SEQ ID NO: 353 - protein, 12 aa, Homo sapiens
TFHADICTLSEK

SEQ ID NO: 354 - protein, 8 aa, Homo sapiens
VFDEFKPL

SEQ ID NO: 355 - protein, 15 aa, Homo sapiens
VFDEFKPLVEEPQNL

SEQ ID NO: 356 - protein, 17 aa, Homo sapiens
VFDEFKPLVEEPQNLIK

SEQ ID NO: 357 - protein, 17 aa, Homo sapiens
VHTECCHGDLLECADDR

SEQ ID NO: 358 - protein, 14 aa, Homo sapiens
VPQVSTPTLVEVSR

SEQ ID NO: 359 - protein, 11 aa, Homo sapiens
VSTPTLVEVSR

SEQ ID NO: 360 - protein, 7 aa, Homo sapiens
YLYEIAR

SEQ ID NO: 361 - protein, 18 aa, Homo sapiens
YTKKVPQVSTPTLVEVSR

SEQ ID NO: 362 - protein, 13 aa, Homo sapiens
DVFLGMFLYEYAR

SEQ ID NO: 363 - protein, 13 aa, Homo sapiens
QNCELFEQLGEYK

SEQ ID NO: 364 - protein, 12 aa, Homo sapiens
YICENQDSISSK

SEQ ID NO: 365 - protein, 6 aa, Homo sapiens
CASLQK

SEQ ID NO: 366 - protein, 12 aa, Homo sapiens
KLVAASQAALGL

SEQ ID NO: 367 - protein, 11 aa, Homo sapiens
LQQCPFEDHVK

SEQ ID NO: 368 - protein, 12 aa, Homo sapiens
FYAPELLFFAKR

SEQ ID NO: 369 - protein, 12 aa, Homo sapiens
AACLLPKLDELR

SEQ ID NO: 370 - protein, 6 aa, Homo sapiens
VFDEFK

SEQ ID NO: 371 - protein, 12 aa, Homo sapiens
RHPDYSVVLLLR

SEQ ID NO: 372 - protein, 15 aa, Homo sapiens
RHPYFYAPELLFFAK

SEQ ID NO: 373 - protein, 7 aa, Homo sapiens
AACLLPK

SEQ ID NO: 374 - protein, 609 aa, Homo sapiens [sequence omitted]

SEQ ID NO: 375 - skipped

SEQ ID NO: 376 - protein, 16 aa, Homo sapiens
APAPAPPGTVTQVDVR

SEQ ID NO: 377 - protein, 10 aa, Homo sapiens
EQFIPPYVPR

SEQ ID NO: 378 - protein, 19 aa, Homo sapiens
ISAAASDSGVESFDEGSSH

SEQ ID NO: 379 - protein, 15 aa, Homo sapiens
NILDIVRPPESGLGR

SEQ ID NO: 380 - protein, 13 aa, Homo sapiens
SQMEEVQDELIHR

SEQ ID NO: 381 - protein, 13 aa, Homo sapiens
VWTQDMILQVDDR

SEQ ID NO: 382 - protein, 10 aa, Homo sapiens
DDILEILDDR

SEQ ID NO: 383 - protein, 14 aa, Homo sapiens
MISNADPSIPPPPR

SEQ ID NO: 384 - protein, 16 aa, Homo sapiens
ANLISEDIESAISDSK

SEQ ID NO: 385 - protein, 822 aa, Homo sapiens
MNGHISNHPSSFGMYPSQMNGYGSSPTFSQTDREHGSKTSAKALYEQRKNYARDSVSSVSDISQYRVEHLTTFVLDRKDAMITVDDGIRKLKLLDAKGKVWTQDMILQVDDRAVSLIDLESKNELENFPLNTIQHCQAVMHSCSYDSVLALVCKEPTQNKPDLHLFQCDEVKANLISEDIESAISDSKGGKQKRRPDALRMISNADPSIPPPPRAPAPAPPGTVTQVDVRSRVAAWSAWAADQGDFEKPRQYHEQEETPEMMAARIDRDVQILNHILDDIEFFITKLQKAAEAFSELSKRKKNKKGKRKGPGEGVLTLRAKPPPPDEFLDCFQKFKHGFNLLAKLKSHIQNPSAADLVHFLFTPLNMVVQATGGPELASSVLSPLLNKDTIDFLNYTVNGDERQLWMSLGGTWMKARAEWPKEQFIPPYVPRFRNGWEPPMLNFMGATMEQDLYQLAESVANVAEHQRKQEIKRLSTEHSSVSEYHPADGYAFSSNIYTRGSHLDQGEAAVAFKPTSNRHIDRNYEPLKTQPKKYAKSKYDFVARNNSELSVLKDDILEILDDRKQWWKVRNASGDSGFVPNNILDIVRPPESGLGRADPPYTHTIQKQRMEYGPRPADTPPAPSPPPTPAPVPVPLPPSTPAPVPVSKVPANITRQNSSSSDSGGSIVRDSQRHKQLPVDRRKSQMEEVQDELIHRLTIGRSAAQKKFHVPRQNVPVINITYDSTPEDVKTWLQSKGFNPVTVNSLGVLNGAQLFSLNKDELRTVCPEGARVYSQITVQKAALEDSSGSSELQEIMRRRQEKISAAASDSGVESFDEGSSH

SEQ ID NO: 386 - protein, 14 aa, Homo sapiens
AHLDIAGSLEGHLR

SEQ ID NO: 387 - protein, 16 aa, Homo sapiens
ATFQTPDFIVPLTDLR

SEQ ID NO: 388 - protein, 21 aa, Homo sapiens
DKDQEVLLQTFLDDASPGDKR

SEQ ID NO: 389 - protein, 9 aa, Homo sapiens
ELPVLHVPR

SEQ ID NO: 390 - protein, 7 aa, Homo sapiens
FLDMLIK

SEQ ID NO: 391 - protein, 19 aa, Homo sapiens
HSITNPLAVLCEFISQSIK

SEQ ID NO: 392 - protein, 19 aa, Homo sapiens
ILGEELGFASLHDLQLLGK

SEQ ID NO: 393 - protein, 14 aa, Homo sapiens
LELELRPTGEIEQY

SEQ ID NO: 394 - protein, 8 aa, Homo sapiens
LHVAGNLK

SEQ ID NO: 395 - protein, 9 aa, Homo sapiens
LIDVISMYR

SEQ ID NO: 396 - protein, 14 aa, Homo sapiens
LVALIPEPSAQQLR

SEQ ID NO: 397 - protein, 16 aa, Homo sapiens
NMGLPDFHIPENLFLK

SEQ ID NO: 398 - protein, 23 aa, Homo sapiens
QSMTLSSEVQIPDFDVDLGTILR

SEQ ID NO: 399 - protein, 12 aa, Homo sapiens
QTIIVVLENVQR

SEQ ID NO: 400 - protein, 18 aa, Homo sapiens
SSEVQIPDFDVDLGTILR

SEQ ID NO: 401 - protein, 11 aa, Homo sapiens
TEVIPPLIENR

SEQ ID NO: 402 - protein, 14 aa, Homo sapiens
TLQGIPQMIGEVIR

SEQ ID NO: 403 - protein, 20 aa, Homo sapiens
TLSSEVQIPDFDVDLGTILR

SEQ ID NO: 404 - protein, 18 aa, Homo sapiens
TQFNNNEYSQDLDAYNTK

SEQ ID NO: 405 - protein, 9 aa, Homo sapiens
VAWHYDEEK

SEQ ID NO: 406 - protein, 20 aa, Homo sapiens
YTYNYEAESSSGVPGTADSR

SEQ ID NO: 407 - protein, 8 aa, Homo sapiens
QSFDLSVK

SEQ ID NO: 408 - protein, 13 aa, Homo sapiens
VTNMGIIIPDFAR

SEQ ID NO: 409 - protein, 13 aa, Homo sapiens
HIQNIDIQHLAGK

SEQ ID NO: 410 - protein, 14 aa, Homo sapiens
VLLDQLGTTISFER

SEQ ID NO: 411 - protein, 12 aa, Homo sapiens
LALWGEHTGQLY

SEQ ID NO: 412 - protein, 10 aa, Homo sapiens
MGIIIPDFAR

SEQ ID NO: 413 - protein, 4563 aa, Homo sapiens
MDPPRPALLALLALPALLLLLLAGARAEEEMLENVSLVCPKDATRFKHLRKYTYNYEAESSSGVPGTADSRSATRINCKVELEVPQLCSFILKTSQCTLKEVYGFNPEGKALLKKTKNSEEFAAAMSRYELKLAIPEGKQVFLYPEKDEPTYILNIKRGIISALLVPPETEEAKQVLFLDTVYGNCSTHFTVKTRKGNVATEISTERDLGQCDRFKPIRTGISPLALIKGMTRPLSTLISSSQSCQYTLDAKRKHVAEAICKEQHLFLPFSYKNKYGMVAQVTQTLKLEDTPKINSRFFGEGTKKMGLAFESTKSTSPPKQAEAVLKTLQELKKLTISEQNIQRANLFNKLVTELRGLSDEAVTSLLPQLIEVSSPITLQALVQCGQPQCSTHILQWLKRVHANPLLIDVVTYLVALIPEPSAQQLREIFNMARDQRSRATLYALSHAVNNYHKTNPTGTQELLDIANYLMEQIQDDCTGDEDYTYLILRVIGNMGQTMEQLTPELKSSILKCVQSTKPSLMIQKAAIQALRKMEPKDKDQEVLLQTFLDDASPGDKRLAAYLMLMRSPSQADINKIVQILPWEQNEQVKNFVASHIANILNSEELDIQDLKKLVKEALKESQLPTVMDFRKFSRNYQLYKSVSLPSLDPASAKIEGNLIFDPNNYLPKESMLKTTLTAFGFASADLIEIGLEGKGFEPTLEALFGKQGFFPDSVNKALYWVNGQVPDGVSKVLVDHFGYTKDDKHEQDMVNGIMLSVEKLIKDLKSKEVPEARAYLRILGEELGFASLHDLQLLGKLLLMGARTLQGIPQMIGEVIRKGSKNDFFLHYIFMENAFELPTGAGLQLQISSSGVIAPGAKAGVKLEVANMQAELVAKPSVSVEFVTNMGIIIPDFARSGVQMNTNFFHESGLEAHVALKAGKLKFIIPSPKRPVKLLSGGNTLHLVSTTKTEVIPPLIENRQSWSVCKQVFPGLNYCTSGAYSNASSTDSASYYPLTGDTRLELELRPTGEIEQYSVSATYELQREDRALVDTLKFVTQAEGAKQTEATMTFKYNRQSMTLSSEVQIPDFDVDLGTILRVNDESTEGKTSYRLTLDIQNKKITEVALMGHLSCDTKEERKIKGVISIPRLQAEARSEILAHWSPAKLLLQMDSSATAYGSTVSKRVAWHYDEEKIEFEWNTGTNVDTKKMTSNFPVDLSDYPKSLHMYANRLLDHRVPQTDMTFRHVGSKLIVAMSSWLQKASGSLPYTQTLQDHLNSLKEFNLQNMGLPDFHIPENLFLKSDGRVKYTLNKNSLKIEIPLPFGGKSSRDLKMLETVRTPALHFKSVGFHLPSREFQVPTFTIPKLYQLQVPLLGVLDLSTNVYSNLYNWSASYSGGNTSTDHFSLRARYHMKADSVVDLLSYNVQGSGETTYDHKNTFTLSCDGSLRHKFLDSNIKFSHVEKLGNNPVSKGLLIFDASSSWGPQMSASVHLDSKKKQHLFVKEVKIDGQFRVSSFYAKGTYGLSCQRDPNTGRLNGESNLRFNSSYLQGTNQITGRYEDGTLSLTSTSDLQSGIIKNTASLKYENYELTLKSDTNGKYKNFATSNKMDMTFSKQNALLRSEYQADYESLRFFSLLSGSLNSHGLELNADILGTDKINSGAHKATLRIGQDGISTSATTNLKCSLLVLENELNAELGLSGASMKLTTNGRFREHNAKFSLDGKAALTELSLGSAYQAMILGVDSKNIFNFKVSQEGLKLSNDMMGSYAEMKFDHTNSLNIAGLSLDFSSKLDNIYSSDKFYKQTVNLQLQPYSLVTTLNSDLKYNALDLTNNGKLRLEPLKLHVAGNLKGAYQNNEIKHIYAISSAALSASYKADTVAKVQGVEFSHRLNTDIAGLASAIDMSTNYNSDSLHFSNVFRSVMAPFTMTIDAHTNGNGKLALWGEHTGQLYSKFLLKAEPLAFTFSHDYKGSTSHHLVSRKSISAALEHKVSALLTPAEQTGTWKLKTQFNNNEYSQDLDAYNTKDKIGVELTGRTLADLTLLDSPIKVPLLLSEPINIIDALEMRDAVEKPQEFTIVAFVKYDKNQDVHSINLPFFETLQEYFERNRQTIIVVLENVQRNLKHINIDQFVRKYRAALGKLPQQANDYLNSFNWERQVSHAKEKLTALTKKYRITENDIQIALDDAKINFNEKLSQLQTYMIQFDQYIKDSYDLHDLKIAIANIIDEIIEKLKSLDEHYHIRVNLVKTIHDLHLFIENIDFNKSGSSTASWIQNVDTKYQIRIQIQEKLQQLKRHIQNIDIQHLAGKLKQHIEAIDVRVLLDQLGTTISFERINDVLEHVKHFVINLIGDFEVAEKINAFRAKVHELIERYEVDQQIQVLMDKLVELAHQYKLKETIQKLSNVLQQVKIKDYFEKLVGFIDDAVKKLNELSFKTFIEDVNKFLDMLIKKLKSFDYHQFVDETNDKIREVTQRLNGEIQALELPQKAEALKLFLEETKATVAVYLESLQDTKITLIINWLQEALSSASLAHMKAKFRETLEDTRDRMYQMDIQQELQRYLSLVGQVYSTLVTYISDWWTLAAKNLTDFAEQYSIQDWAKRMKALVEQGFTVPEIKTILGTMPAFEVSLQALQKATFQTPDFIVPLTDLRIPSVQINFKDLKNIKIPSRFSTPEFTILNTFHIPSFTIDFVEMKVKIIRTIDQMLNSELQWPVPDIYLRDLKVEDIPLARITLPDFRLPEIAIPEFIIPTLNLNDFQVPDLHIPEFQLPHISHTIEVPTFGKLYSILKIQSPLFTLDANADIGNGTTSANEAGIAASITAKGESKLEVLNFDFQANAQLSNPKINPLALKESVKFSSKYLRTEHGSEMLFFGNAIEGKSNTVASLHTEKNTLELSNGVIVKINNQLTLDSNTKYFHKLNIPKLDFSSQADLRNEIKTLLKAGHIAWTSSGKGSWKWACPRFSDEGTHESQISFTIEGPLTSFGLSNKINSKHLRVNQNLVYESGSLNFSKLEIQSQVDSQHVGHSVLTAKGMALFGEGKAEFTGRHDAHLNGKVIGTLKNSLFFSAQPFEITASTNNEGNLKVRFPLRLTGKIDFLNNYALFLSPSAQQASWQVSARFNQYKYNQNFSAGNNENIMEAHVGINGEANLDFLNIPLTIPEMRLPYTIITTPPLKDFSLWEKTGLKEFLKTTKQSFDLSVKAQYKKNKHRHSITNPLAVLCEFISQSIKSFDRHFEKNRNNALDFVTKSYNETKIKFDKYKAEKSHDELPRTFQIPGYTVPVVNVEVSPFTIEMSAFGYVFPKAVSMPSFSILGSDVRVPSYTLILPSLELPVLHVPRNLKLSLPDFKELCTISHIFIPAMGNITYDFSFKSSVITLNTNAELFNQSDIVAHLLSSSSSVIDALQYKLEGTTRLTRKRGLKLATALSLSNKFVEGSHNSTVSLTTKNMEVSVATTTKAQIPILRMNFKQELNGNTKSKPTVSSSMEFKYDFNSSMLYSTAKGAVDHKLSLESLTSYFSIESSTKGDVKGSVLSREYSGTIASEANTYLNSKSTRSSVKLQGTSKIDDIWNLEVKENFAGEATLQRIYSLWEHSTKNHLQLEGLFFTNGEHTSKATLELSPWQMSALVQVHASQPSSFHDFPDLGQEVALNANTKNQKIRWKNEVRIHSGSFQSQVELSNDQEKAHLDIAGSLEGHLRFLKNIILPVYDKSLWDFLKLDVTTSIGRRQHLRVSTAFVYTKNPNGYSFSIPVKVLADKFIIPGLKLNDLNSVLVMPTFHVPFTDLQVPSCKLDFREIQIYKKLRTSSFALNLPTLPEVKFPEVDVLTKYSQPEDSLIPFFEITVPESQLTVSQFTLPKSVSDGIAALDLNAVANKIADFELPTIIVPEQTIEIPSIKFSVPAGIVIPSFQALTARFEVDSPVYNATWSASLKNKADYVETVLDSTCSSTVQFLEYELNVLGTHKIEDGTLASKTKGTFAHRDFSAEYEEDGKYEGLQEWEGKAHLNIKSPAFTDLHLRYQKDKKGISTSAASPAVGTVGMDMDEDDDFSKWNFYYSPQSSPDKKLTIFKTELRVRESDEETQIKVNWEEEAASGLLTSLKDNVPKATGVLYDYVNKYHWEHTGLTLREVSSKLRRNLQNNAEWVYQGAIRQIDDIDVRFQKAASGTTGTYQEWKDKAQNLYQELLTQEGQASFQGLKDNVFDGLVRVTQEFHMKVKHLIDSLIDFLNFPRFQFPGKPGIYTREELCTMFIREVGTVLSQVYSKVHNGSEILFSYFQDLVITLPFELRKHKLIDVISMYRELLKDLSKEAQEVFKAIQSLKTTEVLRNLQDLLQFIFQLIEDNIKQLKEMKFTYLINYIQDEINTIFSDYIPYVFKLLKENLCLNLHKFNEFIQNELQEASQELQQIHQYIMALREEYFDPSIVGWTVKYYELEEKIVSLIKNLLVALKDFHSEYIVSASNFTSQLSSQVEQFLHRNIQEYLSILTDPDGKGKEKIAELSATAQEIIKSQAIATKKIISDYHQQFRYKLQDFSDQLSDYYEKFIAESKRLIDLSIQNYHTFLIYITELLKKLQSTTVMNPYMKLAPGELTIIL

SEQ ID NO: 414 - protein, 17 aa, Homo sapiens
EGGLGPLNIPLLADVTR

SEQ ID NO: 415 - protein, 18 aa, Homo sapiens
KEGGLGPLNIPLLADVTR

SEQ ID NO: 416 - protein, 11 aa, Homo sapiens
QITVNDLPVGR

SEQ ID NO: 417 - protein, 198 aa, Homo sapiens
MASGNARIGKPAPDFKATAVVDGAFKEVKLSDYKGKYVVLFFYPLDFTFVCPTEIIAFSNRAEDFRKLGCEVLGVSVDSQFTHLAWINTPRKEGGLGPLNIPLLADVTRRLSEDYGVLKTDEGIAYRGLFIIDGKGVLRQITVNDLPVGRSVDEALRLVQAFQYTDEHGEVCPAGWKPGSDTIKPNVDDSKEYFSKHN

SEQ ID NO: 418 - protein, 12 aa, Homo sapiens
AWEPWLPAEALR

SEQ ID NO: 419 - protein, 6 aa, Homo sapiens
LCNLLK

SEQ ID NO: 420 - protein, 631 aa, Homo sapiens
MPRYGASLRQSCPRSGREQGQDGTAGAPGLLWMGLVLALALALALALALSDSRVLWAPAEAHPLSPQGHPARLHRIVPRLRDVFGWGNLTCPICKGLFTAINLGLKKEPNVARVGSVAIKLCNLLKIAPPAVCQSIVHLFEDDMVEVWRRSVLSPSEACGLLLGSTCGHWDIFSSWNISLPTVPKPPPKPPSPPAPGAPVSRILFLTDLHWDHDYLEGTDPDCADPLCCRRGSGLPPASRPGAGYWGEYSKCDLPLRTLESLLSGLGPAGPFDMVYWTGDIPAHDVWHQTRQDQLRALTTVTALVRKFLGPVPVYPAVGNHESTPVNSFPPPFIEGNHSSRWLYEAMAKAWEPWLPAEALRTLRIGGFYALSPYPGLRLISLNMNFCSRENFWLLINSTDPAGQLQWLVGELQAAEDRGDKVHIIGHIPPGHCLKSWSWNYYRIVARYENTLAAQFFGHTHVDEFEVFYDEETLSRPLAVAFLAPSATTYIGLNPGYRVYQIDGNYSGSSHVVLDHETYILNLTQANIPGAIPHWQLLYRARETYGLPNTLPTAWHNLVYRMRGDMQLFQTFWFLYHKGHPPSEPCGTPCRLATLCAQLSARADSPALCRHLMPDGSLPEAQSLWPRPLFC

SEQ ID NO: 421 - protein, 11 aa, Homo sapiens
FILNLPTFSVR

SEQ ID NO: 422 - protein, 16 aa, Homo sapiens
LIGIQGPDYVLVASDR

SEQ ID NO: 423 - protein, 18 aa, Homo sapiens
HVNLLLAGYDEHEGPALY

SEQ ID NO: 424 - protein, 201 aa, Homo sapiens
MEYLIGIQGPDYVLVASDRVAASNIVQMKDDHDKMFKMSEKILLLCVGEAGDTVQFAEYIQKNVQLYKMRNGYELSPTAAANFTRRNLADCLRSRTPYHVNLLLAGYDEHEGPALYYMDYLAALAKAPFAAHGYGAFLTLSILDRYYTPTISRERAVELLRKCLEELQKRFILNLPTFSVRIIDKNGIHDLDNISFPKQGS

SEQ ID NO: 425 - protein, 20 aa, Homo sapiens
LLSQQQADGSFQDLSPVIHR

SEQ ID NO: 426 - protein, 14 aa, Homo sapiens
AIWNVINWENVTER

SEQ ID NO: 427 - protein, 9 aa, Homo sapiens
DFGSFDKFK

SEQ ID NO: 428 - protein, 13 aa, Homo sapiens
FNGGGHINHSIFW

SEQ ID NO: 429 - protein, 14 aa, Homo sapiens
GDVTAQIALQPALK

SEQ ID NO: 430 - protein, 9 aa, Homo sapiens
GELLEAIKR

SEQ ID NO: 431 - protein, 15 aa, Homo sapiens
HHAAYVNNLNVTEEK

SEQ ID NO: 432 - protein, 8 aa, Homo sapiens
NVRPDYLK

SEQ ID NO: 433 - protein, 7 aa, Homo sapiens
GWLGFNK

SEQ ID NO: 434 - protein, 7 aa, Homo sapiens
YQEALAK

SEQ ID NO: 435 - protein, 15 aa, Homo sapiens
ALGISPFHEHAEVVF

SEQ ID NO: 436 - protein, 23 aa, Homo sapiens
ALGISPFHEHAEVVFTANDSGPR

SEQ ID NO: 437 - protein, 13 aa, Homo sapiens
GSPAINVAVHVFR

SEQ ID NO: 438 - protein, 14 aa, Homo sapiens
KAADDTWEPFASGK

SEQ ID NO: 439 - protein, 22 aa, Homo sapiens
TSESGELHGLTTEEEFVEGIYK

SEQ ID NO: 440 - protein, 13 aa, Homo sapiens
AADDTWEPFASGK

SEQ ID NO: 441 - protein, 147 aa, Homo sapiens
MASHRLLLLCLAGLVFVSEAGPTGTGESKCPLMVKVLDAVRGSPAINVAVHVFRKAADDTWEPFASGKTSESGELHGLTTEEEFVEGIYKVEIDTKSYWKALGISPFHEHAEVVFTANDSGPRRYTIAALLSPYSYSTTAVVTNPKE

SEQ ID NO: 442 - protein, 20 aa, Homo sapiens
AVHDLEEDTWYATGILSFDK

SEQ ID NO: 443 - protein, 8 aa, Homo sapiens
GSFPWQAK

SEQ ID NO: 444 - protein, 11 aa, Homo sapiens
HYEGSTVPEKK

SEQ ID NO: 445 - protein, 9 aa, Homo sapiens
ILGGHLDAK

SEQ ID NO: 446 - protein, 20 aa, Homo sapiens
SPVGVQPILNEHTFCAGMSK

SEQ ID NO: 447 - protein, 16 aa, Homo sapiens
VMPICLPSKDYAEVGR

SEQ ID NO: 448 - protein, 10 aa, Homo sapiens
VTSIQDWVQK

SEQ ID NO: 449 - protein, 14 aa, Homo sapiens
YVMLPVADQDQCIR

SEQ ID NO: 450 - protein, 6 aa, Homo sapiens
FTDHLK

SEQ ID NO: 451 - protein, 12 aa, Homo sapiens
EFTRPEEIIFLR

SEQ ID NO: 452 - protein, 11 aa, Homo sapiens
IIFDITEGNLR

SEQ ID NO: 453 - protein, 703 aa, Homo sapiens
MERAAPSRRVPLPLLLLGGLALLAAGVDADVLLEACCADGHRMATHQKDCSLPYATESKECRMVQEQCCHSQLEELHCATGISLANEQDRCATPHGDNASLEATFVKRCCHCCLLGRAAQAQGQSCEYSLMVGYQCGQVFRACCVKSQETGDLDVGGLQETDKIIEVEEEQEDPYLNDRCRGGGPCKQQCRDTGDEVVCSCFVGYQLLSDGVSCEDVNECITGSHSCRLGESCINTVGSFRCQRDSSCGTGYELTEDNSCKDIDECESGIHNCLPDFICQNTLGSFRCRPKLQCKSGFIQDALGNCIDINECLSISAPCPIGHTCINTEGSYTCQKNVPNCGRGYHLNEEGTRCVDVDECAPPAEPCGKGHRCVNSPGSFRCECKTGYYFDGISRMCVDVNECQRYPGRLCGHKCENTLGSYLCSCSVGFRLSVDGRSCEDINECSSSPCSQECANVYGSYQCYCRRGYQLSDVDGVTCEDIDECALPTGGHICSYRCINIPGSFQCSCPSSGYRLAPNGRNCQDIDECVTGIHNCSINETCFNIQGGFRCLAFECPENYRRSAATLQQEKTDTVRCIKSCRPNDVTCVFDPVHTISHTVISLPTFREFTRPEEIIFLRAITPPHPASQANIIFDITEGNLRDSFDIIKRYMDGMTVGVVRQVRPIVGPFHAVLKLEMNYVVGGVVSHRNVVNVHIFVSEYWF

SEQ ID NO: 454 - protein, 23 aa, Homo sapiens
AFLEVNEEGSEAAASTAVVIAGR

SEQ ID NO: 455 - protein, 12 aa, Homo sapiens
EVPLNTIIFMGR

SEQ ID NO: 456 - protein, 13 aa, Homo sapiens
VAEGTQVLELPFK

SEQ ID NO: 457 - protein, 25 aa, Homo sapiens
ELTPEVLQEWLDELEEMMLVVHMPR

SEQ ID NO: 458 - protein, 17 aa, Homo sapiens
ATEDEGSEQKIPEATNR

SEQ ID NO: 459 - protein, 464 aa, Homo sapiens
MYSNVIGTVTSGKRKVYLLSLLLIGFWDCVTCHGSPVDICTAKPRDIPMNPMCIYRSPEKKATEDEGSEQKIPEATNRRVWELSKANSRFATTFYQHLADSKNDNDNIFLSPLSISTAFAMTKLGACNDTLQQLMEVFKFDTISEKTSDQIHFFFAKLNCRLYRKANKSSKLVSANRLFGDKSLTFNETYQDISELVYGAKLQPLDFKENAEQSRAAINKWVSNKTEGRITDVIPSEAINELTVLVLVNTIYFKGLWKSKFSPENTRKELFYKADGESCSASMMYQEGKFRYRRVAEGTQVLELPFKGDDITMVLILPKPEKSLAKVEKELTPEVLQEWLDELEEMMLVVHMPRFRIEDGFSLKEQLQDMGLVDLFSPEKSKLPGIVAEGRDDLYVSDAFHKAFLEVNEEGSEAAASTAVVIAGRSLNPNRVTFKANRPFLVFIREVPLNTIIFMGRVANPCVK

SEQ ID NO: 460 - protein, 16 aa, Homo sapiens
LLELFTDLSCNPEMMK

SEQ ID NO: 461 - protein, 25 aa, Homo sapiens
NAADSYFSLLQGFINSLDESTQESK

SEQ ID NO: 462 - protein, 18 aa, Homo sapiens
SLLQGFINSLDESTQESK

SEQ ID NO: 463 - protein, 6 aa, Homo sapiens
YIQNFK

SEQ ID NO: 464 - protein, 11 aa, Homo sapiens
IPTEAPQLELK

SEQ ID NO: 465 - protein, 411 aa, Homo sapiens
MTHWFHRNPLKATAPVSFNYYGVVTGPSASKICNDLRSSRARLLELFTDLSCNPEMMKNAADSYFSLLQGFINSLDESTQESKLRYIQNFKWTDTLQGQVPSAQQDAVFELISMGFNVALWYTKYASRLAGKENITEDEAKEVHRSLKIAAGIFKHLKESHLPKLITPAEKGRDLESRLIEAYVIQCQAEAQEVTIARAIELKHAPGLIAALAYETANFYQKADHTLSSLEPAYSAKWRKYLHLKMCFYTAYAYCYHGETLLASDKCGEAIRSLQEAEKLYAKAEALCKEYGETKGPGPTVKPSGHLFFRKLGNLVKNTLEKCQRENGFIYFQKIPTEAPQLELKANYGLVEPIPFEFPPTSVQWTPETLAAFDLTKRPKDDSTKPKPEEEVKPVKEPDIKPQKDTGCYIS

SEQ ID NO: 466 - protein, 10 aa, Homo sapiens
ELGDHVTNLR

SEQ ID NO: 467 - protein, 10 aa, Homo sapiens
GGRIFLQDIK

SEQ ID NO: 468 - protein, 15 aa, Homo sapiens
LCDFIETHYLNEQVK

SEQ ID NO: 469 - protein, 15 aa, Homo sapiens
MGAPESGLAEYLFDK

SEQ ID NO: 470 - protein, 19 aa, Homo sapiens
NDPHLCDFIETHYLNEQVK

SEQ ID NO: 471 - protein, 11 aa, Homo sapiens
NVNQSLLELHK

SEQ ID NO: 472 - protein, 10 aa, Homo sapiens
YFLHQSHEER

SEQ ID NO: 473 - protein, 9 aa, Homo sapiens
LCDFIETHY

SEQ ID NO: 474 - protein, 7 aa, Homo sapiens
IFLQDIK

SEQ ID NO: 475 - protein, 183 aa, Homo sapiens
MTTASTSQVRQNYHQDSEAAINRQINLELYASYVYLSMSYYFDRDDVALKNFAKYFLHQSHEEREHAEKLMKLQNQRGGRIFLQDIKKPDCDDWESGLNAMECALHLEKNVNQSLLELHKLATDKNDPHLCDFIETHYLNEQVKAIKELGDHVTNLRKMGAPESGLAEYLFDKHTLGDSDNES

SEQ ID NO: 476 - protein, 20 aa, Homo sapiens
FFGHGAEDSLADQAANEWGR

SEQ ID NO: 477 - protein, 14 aa, Homo sapiens
SFFSFLGEAFDGAR

SEQ ID NO: 478 - protein, 15 aa, Homo sapiens
GPGGAWAAEVISDAR

SEQ ID NO: 479 - protein, 11 aa, Homo sapiens
LSDQFHDILIR

SEQ ID NO: 480 - protein, 27 aa, Homo sapiens
SGVISDTELQQALSNGTWTPFNPVTVR

SEQ ID NO: 481 - protein, 10 aa, Homo sapiens
YITDWQNVFR

SEQ ID NO: 482 - protein, 13 aa, Homo sapiens
AGVNFSEFTGVWK

SEQ ID NO: 483 - protein, 191 aa, Homo sapiens
MAAYSYRPGPGAGPGPAAGAALPDQSFLWNVFQRVDKDRSGVISDTELQQALSNGTWTPFNPVTVRSIISMFDRENKAGVNFSEFTGVWKYITDWQNVFRTYDRDNSGMIDKNELKQALSGFGYRLSDQFHDILIRKFDRQGRGQIAFDDFIQGCIVLQRLTDIFRRYDTDQDGWIQVSYEQYLSMVFSIV

SEQ ID NO: 484 - protein, 17 aa, Homo sapiens
GVTSVSQIFHSPDLAIR

SEQ ID NO: 485 - protein, 13 aa, Homo sapiens
KYPVAHFIDQTLK

SEQ ID NO: 486 - protein, 14 aa, Homo sapiens
LEDMEQALSPSVFK

SEQ ID NO: 487 - protein, 10 aa, Homo sapiens
LLDSLPSDTR

SEQ ID NO: 488 - protein, 12 aa, Homo sapiens
LVLLNAIYLSAK

SEQ ID NO: 489 - protein, 25 aa, Homo sapiens
QHQTVLELTETGVEAAAASAISVAR

SEQ ID NO: 490 - protein, 23 aa, Homo sapiens
QTVLELTETGVEAAAASAISVAR

SEQ ID NO: 491 - protein, 10 aa, Homo sapiens
DFTCVHQALK

SEQ ID NO: 492 - protein, 16 aa, Homo sapiens
APPPSLTDCIGTVDSR

SEQ ID NO: 493 - protein, 27 aa, Homo sapiens
IDQIEDLQDQLEDMMEDANEIQEALSR

SEQ ID NO: 494 - protein, 6 aa, Homo sapiens
YKDQIK

SEQ ID NO: 495 - protein, 19 aa, Homo sapiens
ENKPSIIFIDEIDSLCGSR

SEQ ID NO: 496 - protein, 13 aa, Homo sapiens
LLEPVVSMSDMLR

SEQ ID NO: 497 - protein, 17 aa, Homo sapiens
LQNQLQGAIVIERPNVK

SEQ ID NO: 498 - protein, 16 aa, Homo sapiens
SLSNTKPTVNEHDLLK

SEQ ID NO: 499 - protein, 444 aa, Homo sapiens
MSSTSPNLQKAIDLASKAAQEDKAGNYEEALQLYQHAVQYFLHVVKYEAQGDKAKQSIRAKCTEYLDRAEKLKEYLKNKEKKAQKPVKEGQPSPADEKGNDSDGEGESDDPEKKKLQNQLQGAIVIERPNVKWSDVAGLEGAKEALKEAVILPIKFPHLFTGKRTPWRGILLFGPPGTGKSYLAKAVATEANNSTFFSISSSDLVSKWLGESEKLVKNLFQLARENKPSIIFIDEIDSLCGSRSENESEAARRIKTEFLVQMQGVGVDNDGILVLGATNIPWVLDSAIRRRFEKRIYIPLPEPHARAAMFKLHLGTTQNSLTEADFRELGRKTDGYSGADISIIVRDALMQPVRKVQSATHFKKVRGPSRADPNHLVDDLLTPCSPGDPGAIEMTWMDVPGDKLLEPVVSMSDMLRSLSNTKPTVNEHDLLKLKKFTEDFGQEG

SEQ ID NO: 500 - protein, 19 aa, Homo sapiens
AFTDLNSINSVLGGGILDR

SEQ ID NO: 501 - protein, 13 aa, Homo sapiens
LLNEDWEYYLSGK

SEQ ID NO: 502 - protein, 11 aa, Homo sapiens
LTFEQVYSDCK

SEQ ID NO: 503 - protein, 17 aa, Homo sapiens
QLPPVDAELDNVNNVLR

SEQ ID NO: 504 - protein, 17 aa, Homo sapiens
SLHQQSTQLSSSLTSVK

SEQ ID NO: 505 - protein, 20 aa, Homo sapiens
TDLDGLVQQGYQSLNDIPDR

SEQ ID NO: 506 - protein, 11 aa, Homo sapiens
TLLNETPEQIK

SEQ ID NO: 507 - protein, 16 aa, Homo sapiens
VLPIEQSLSTLYQSVK

SEQ ID NO: 508 - protein, 13 aa, Homo sapiens
VNLNIFLLGAAGR

SEQ ID NO: 509 - protein, 865 aa, Homo sapiens
MALVLGSLLLLGLCGNSFSGGQPSSTDAPKAWNYELPATNYETQDSHKAGPIGILFELVHIFLYVVQPRDFPEDTLRKFLQKAYESKIDYDKPETVILGLKIVYYEAGIILCCVLGLLFIILMPLVGYFFCMCRCCNKCGGEMHQRQKENGPFLRKCFAISLLVICIIISIGIFYGFVANHQVRTRIKRSRKLADSNFKDLRTLLNETPEQIKYILAQYNTTKDKAFTDLNSINSVLGGGILDRLRPNIIPVLDEIKSMATAIKETKEALENMNSTLKSLHQQSTQLSSSLTSVKTSLRSSLNDPLCLVHPSSETCNSIRLSLSQLNSNPELRQLPPVDAELDNVNNVLRTDLDGLVQQGYQSLNDIPDRVQRQTTTVVAGIKRVLNSIGSDIDNVTQRLPIQDILSAFSVYVNNTESYIHRNLPTLEEYDSYWWLGGLVICSLLTLIVIFYYLGLLCGVCGYDRHATPTTRGCVSNTGGVFLMVGVGLSFLFCWILMIIVVLTFVFGANVEKLICEPYTSKELFRVLDTPYLLNEDWEYYLSGKLFNKSKMKLTFEQVYSDCKKNRGTYGTLHLQNSFNISEHLNINEHTGSISSELESLKVNLNIFLLGAAGRKNLQDFAACGIDRMNYDSYLAQTGKSPAGVNLLSFAYDLEAKANSLPPGNLRNSLKRDAQTIKTIHQQRVLPIEQSLSTLYQSVKILQRTGNGLLERVTRILASLDFAQNFITNNTSSVIIEETKKYGRTIIGYFEHYLQWIEFSISEKVASCKPVATALDTAVDVFLCSYIIDPLNLFWFGIGKATVFLLPALIFAVKLAKYYRRMDSEDVYDDVETIPMKNMENGNNGYHKDHVYGIHNPVMTSPSQH

SEQ ID NO: 510 - protein, 16 aa, Homo sapiens
AAPLQGMLPGLLAPLR

SEQ ID NO: 511 - protein, 24 aa, Homo sapiens
GADQAELEEIAFDSSLVFIPAEFR

SEQ ID NO: 512 - protein, 24 aa, Homo sapiens
GAQGPAGPAGPPGLIGEQGISGPR

SEQ ID NO: 513 - protein, 16 aa, Homo sapiens
ITEGVPQLLIVLTADR

SEQ ID NO: 514 - protein, 13 aa, Homo sapiens
LVDYLDVGFDTTR

SEQ ID NO: 515 - protein, 19 aa, Homo sapiens
MKPLDGSALYTGSALDFVR

SEQ ID NO: 516 - protein, 3177 aa, Homo sapiens
MRKHRHLPLVAVFCLFLSGFPTTHAQQQQADVKNGAAADIIFLVDSSWTIGEEHFQLVREFLYDVVKSLAVGENDFHFALVQFNGNPHTEFLLNTYRTKQEVLSHISNMSYIGGTNQTGKGLEYIMQSHLTKAAGSRAGDGVPQVIVVLTDGHSKDGLALPSAELKSADVNVFAIGVEDADEGALKEIASEPLNMHMFNLENFTSLHDIVGNLVSCVHSSVSPERAGDTETLKDITAQDSADIIFLIDGSNNTGSVNFAVILDFLVNLLEKLPIGTQQIRVGVVQFSDEPRTMFSLDTYSTKAQVLGAVKALGFAGGELANIGLALDFVVENHFTRAGGSRVEEGVPQVLVLISAGPSSDEIRYGVVALKQASVFSFGLGAQAASRAELQHIATDDNLVFTVPEFRSFGDLQEKLLPYIVGVAQRHIVLKPPTIVTQVIEVNKRDIVFLVDGSSALGLANFNAIRDFIAKVIQRLEIGQDLIQVAVAQYADTVRPEFYFNTHPTKREVITAVRKMKPLDGSALYTGSALDFVRNNLFTSSAGYRAAEGIPKLLVLITGGKSLDEISQPAQELKRSSIMAFAIGNKGADQAELEEIAFDSSLVFIPAEFRAAPLQGMLPGLLAPLRTLSGTPEVHSNKRDIIFLLDGSANVGKTNFPYVRDFVMNLVNSLDIGNDNIRVGLVQFSDTPVTEFSLNTYQTKSDILGHLRQLQLQGGSGLNTGSALSYVYANHFTEAGGSRIREHVPQLLLLLTAGQSEDSYLQAANALTRAGILTFCVGASQANKAELEQIAFNPSLVYLMDDFSSLPALPQQLIQPLTTYVSGGVEEVPLAQPESKRDILFLFDGSANLVGQFPVVRDFLYKIIDELNVKPEGTRIAVAQYSDDVKVESRFDEHQSKPEILNLVKRMKIKTGKALNLGYALDYAQRYIFVKSAGSRIEDGVLQFLVLLVAGRSSDRVDGPASNLKQSGVVPFIFQAKNADPAELEQIVLSPAFILAAESLPKIGDLHPQIVNLLKSVHNGAPAPVSGEKDVVFLLDGSEGVRSGFPLLKEFVQRVVESLDVGQDRVRVAVVQYSDRTRPEFYLNSYMNKQDVVNAVRQLTLLGGPTPNTGAALEFVLRNILVSSAGSRITEGVPQLLIVLTADRSGDDVRNPSVVVKRGGAVPIGIGIGNADITEMQTISFIPDFAVAIPTFRQLGTVQQVISERVTQLTREELSRLQPVLQPLPSPGVGGKRDVVFLIDGSQSAGPEFQYVRTLIERLVDYLDVGFDTTRVAVIQFSDDPKVEFLLNAHSSKDEVQNAVQRLRPKGGRQINVGNALEYVSRNIFKRPLGSRIEEGVPQFLVLISSGKSDDEVDDPAVELKQFGVAPFTIARNADQEELVKISLSPEYVFSVSTFRELPSLEQKLLTPITTLTSEQIQKLLASTRYPPPAVESDAADIVFLIDSSEGVRPDGFAHIRDFVSRIVRRLNIGPSKVRVGVVQFSNDVFPEFYLKTYRSQAPVLDAIRRLRLRGGSPLNTGKALEFVARNLFVKSAGSRIEDGVPQHLVLVLGGKSQDDVSRFAQVIRSSGIVSLGVGDRNIDRTELQTITNDPRLVFTVREFRELPNIEERIMNSFGPSAATPAPPGVDTPPPSRPEKKKADIVFLLDGSINFRRDSFQEVLRFVSEIVDTVYEDGDSIQVGLVQYNSDPTDEFFLKDFSTKRQIIDAINKVVYKGGRHANTKVGLEHLRVNHFVPEAGSRLDQRVPQIAFVITGGKSVEDAQDVSLALTQRGVKVFAVGVRNIDSEEVGKIASNSATAFRVGNVQELSELSEQVLETLHDAMHETLCPGVTDAAKACNLDVILGFDGSRDQNVFVAQKGFESKVDAILNRISQMHRVSCSGGRSPTVRVSVVANTPSGPVEAFDFDEYQPEMLEKFRNMRSQHPYVLTEDTLKVYLNKFRQSSPDSVKVVIHFTDGADGDLADLHRASENLRQEGVRALILVGLERVVNLERLMHLEFGRGFMYDRPLRLNLLDLDYELAEQLDNIAEKACCGVPCKCSGQRGDRGPIGSIGPKGIPGEDGYRGYPGDEGGPGERGPPGVNGTQGFQGCPGQRGVKGSRGFPGEKGEVGEIGLDGLDGEDGDKGLPGSSGEKGNPGRRGDKGPRGEKGERGDVGIRGDPGNPGQDSQERGPKGETGDLGPMGVPGRDGVPGGPGETGKNGGFGRRGPPGAKGNKGGPGQPGFEGEQGTRGAQGPAGPAGPPGLIGEQGISGPRGSGGAAGAPGERGRTGPLGRKGEPGEPGPKGGIGNRGPRGETGDDGRDGVGSEGRRGKKGERGFPGYPGPKGNPGEPGLNGTTGPKGIRGRRGNSGPPGIVGQKGDPGYPGPAGPKGNRGDSIDQCALIQSIKDKCPCCYGPLECPVFPTELAFALDTSEGVNQDTFGRMRDVVLSIVNDLTIAESNCPRGARVAVVTYNNEVTTEIRFADSKRKSVLLDKIKNLQVALTSKQQSLETAMSFVARNTFKRVRNGFLMRKVAVFFSNTPTRASPQLREAVLKLSDAGITPLFLTRQEDRQLINALQINNTAVGHALVLPAGRDLTDFLENVLTCHVCLDICNIDPSCGFGSWRPSFRDRRAAGSDVDIDMAFILDSAETTTLFQFNEMKKYIAYLVRQLDMSPDPKASQHFARVAVVQHAPSESVDNASMPPVKVEFSLTDYGSKEKLVDFLSRGMTQLQGTRALGSAIEYTIENVFESAPNPRDLKIVVLMLTGEVPEQQLEEAQRVILQAKCKGYFFVVLGIGRKVNIKEVYTFASEPNDVFFKLVDKSTELNEEPLMRFGRLLPSFVSSENAFYLSPDIRKQCDWFQGDQPTKNLVKFGHKQVNVPNNVTSSPTSNPVTTTKPVTTTKPVTTTTKPVTTTTKPVTIINQPSVKPAAAKPAPAKPVAAKPVATKMATVRPPVAVKPATAAKPVAAKPAAVRPPAAAAAKPVATKPEVPRPQAAKPAATKPATTKPMVKMSREVQVFEITENSAKLHWERAEPPGPYFYDLTVTSAHDQSLVLKQNLTVTDRVIGGLLAGQTYHVAVVCYLRSQVRATYHGSFSTKKSQPPPPQPARSASSSTINLMVSTEPLALTETDICKLPKDEGTCRDFILKWYYDPNTKSCARFWYGGCGGNENKFGSQKECEKVCAPVLAKPGVISVMGT

SEQ ID NO: 517 - protein, 18 aa, Homo sapiens
ANTVLSGGTTMYPGIADR

SEQ ID NO: 518 - protein, 21 aa, Homo sapiens
DLYANTVLSGGTTMYPGIADR

SEQ ID NO: 519 - protein, 22 aa, Homo sapiens
KDLYANTVLSGGTTMYPGIADR

SEQ ID NO: 520 - protein, 23 aa, Homo sapiens
LCYVALDFEQEMATAASSSSLEK

SEQ ID NO: 521 - protein, 22 aa, Homo sapiens
TTGIVMDSGDGVTHTVPIYEGY

SEQ ID NO: 522 - protein, 30 aa, Homo sapiens
TTGIVMDSGDGVTHTVPIYEGYALPHAILR

SEQ ID NO: 523 - protein, 16 aa, Homo sapiens
TVLSGGTTMYPGIADR

SEQ ID NO: 524 - protein, 20 aa, Homo sapiens
VALDFEQEMATAASSSSLEK

SEQ ID NO: 525 - protein, 18 aa, Homo sapiens
VAPEEHPVLLTEAPLNPK

SEQ ID NO: 526 - protein, 16 aa, Homo sapiens
YPIEHGIVTNWDDMEK

SEQ ID NO: 527 - protein, 12 aa, Homo sapiens
LHIFDFDVDPLR

SEQ ID NO: 528 - protein, 12 aa, Homo sapiens
QGAESVLQNGLR

SEQ ID NO: 529 - protein, 618 aa, Homo sapiens
MEVKNFAVWDYVVFAALFFISSGIGVFFAIKERKKATSREFLVGGRQMSFGPVGLSLTASFMSAVTVLGTPSEVYRFGASFLVFFIAYLFVILLTSELFLPVFYRSGITSTYEYLQLRFNKPVRYAATVIYIVQTILYTGVVVYAPALALNQVTGFDLWGSVFATGIVCTFYCTLGGLKAVVWTDAFQMVVMIVGFLTVLIQGSTHAGGFHNVLEQSTNGSRLHIFDFDVDPLRRHTFWTITVGGTFTWLGIYGVNQSTIQRCISCKTEKHAKLALYFNLLGLWIILVCAVFSGLIMYSHFKDCDPWTSGIISAPDQLMPYFVMEIFATMPGLPGLFVACAFSGTLSTVASSINALATVTFEDFVKSCFPHLSDKLSTWISKGLCLLFGVMCTSMAVAASVMGGVVQASLSIHGMCGGPMLGLFSLGIVFPFVNWKGALGGLLTGITLSFWVAIGAFIYPAPASKTWPLPLSTDQCIKSNVTATGPPVLSSRPGIADTWYSISYLYYSAVGCLGCIVAGVIISLITGRQRGEDIQPLLIRPVCNLFCFWSKKYKTLCWCGVQHDSGTEQENLENGSARKQGAESVLQNGLRRESLVHVPGYDPKDKSYNNMAFETTHF

SEQ ID NO: 530 - protein, 15 aa, Homo sapiens
KLPVESIQIVLEELR

SEQ ID NO: 531 - protein, 176 aa, Homo sapiens
MAMSFEWPWQYRFPPFFTLQPNVDTRQKQLAAWCSLVLSFCRLHKQSSMTVMEAQESPLFNNVKLQRKLPVESIQIVLEELRKKGNLEWLDKSKSSFLIMWRRPEEWGKLIYQWVSRSGQNNSVFTLYELTNGEDTEDEEFHGLDEATLLRALQALQQEHKAEIITVSDGRGVKFF

SEQ ID NO: 532 - protein, 12 aa, Homo sapiens
AHLVAVFNEYQR

SEQ ID NO: 533 - protein, 16 aa, Homo sapiens
GFGTDEQAIIDCLGSR

SEQ ID NO: 534 - protein, 13 aa, Homo sapiens
GTITDAPGFDPLR

SEQ ID NO: 535 - protein, 16 aa, Homo sapiens
GVGTDEACLIEILASR

SEQ ID NO: 536 - protein, 16 aa, Homo sapiens
QLAQIDGTLSTIEFQR

SEQ ID NO: 537 - protein, 10 aa, Homo sapiens
KIEQELTAAK

SEQ ID NO: 538 - protein, 7 aa, Homo sapiens
KQEFLEK

SEQ ID NO: 539 - protein, 224 aa, Homo sapiens
MSVFGKLFGAGGGKAGKGGPTPQEAIQRLRDTEEMLSKKQEFLEKKIEQELTAAKKHGTKNKRAALQALKRKKRYEKQLAQIDGTLSTIEFQREALENANTNTEVLKNMGYAAKAMKAAHDNMDIDKVDELMQDIADQQELAEEISTAISKPVGFGEEFDEDELMAELEELEQEELDKNLLEISGPETVPLPNVPSIALPSKPAKKKEEEDDDMKELENWAGSM

SEQ ID NO: 540 - protein, 20 aa, Homo sapiens
NTEISFILGQEFDEVTADDR

SEQ ID NO: 541 - protein, 12 aa, Homo sapiens
LVSSENFDDYMK

SEQ ID NO: 542 - protein, 132 aa, Homo sapiens
MCDAFVGTWKLVSSENFDDYMKEVGVGFATRKVAGMAKPNMIISVNGDVITIKSESTFKNTEISFILGQEFDEVTADDRKVKSTITLDGGVLVHVQKWDGKSTTIKRKREDDKLVVECVMKGVTSTRVYERA

SEQ ID NO: 543 - protein, 15 aa, Homo sapiens
VGDGPQQEPGEDEER

SEQ ID NO: 544 - protein, 686 aa, Homo sapiens
MAEAAEPEGVAPGPQGPPEVPAPLAERPGEPGAAGGEAEGPEGSEGAEEAPRGAAAVKEAGGGGPDRGPEAEARGTRGAHGETEAEEGAPEGAEVPQGGEETSGAQQVEGASPGRGAQGEPRGEAQREPEDSAAPERQEEAEQRPEVPEGSASGEAGDSVDAEGPLGDNIEAEGPAGDSVEAEGRVGDSVDAEGPAGDSVDAEGPLGDNIQAEGPAGDSVDAEGRVGDSVDAEGPAGDSVDAEGRVGDSVEAGDPAGDGVEAGVPAGDSVEAEGPAGDSMDAEGPAGRARRVSGEPQQSGDGSLSPQAEAIEVAAGESAGRSPGELAWDAAEEAEVPGVKGSEEAAPGDARADAGEDRVGDGPQQEPGEDEERRERSPEGPREEEAAGGEEESPDSSPHGEASRGAAEPEAQLSNHLAEEGPAEGSGEAARVNGRREDGEASEPRALGQEHDITLFVKAGYDGESIGNCPFSQRLFMILWLKGVIFNVTTVDLKRKPADLQNLAPGTNPPFMTFDGEVKTDVNKIEEFLEEKLAPPRYPKLGTQHPESNSAGNDVFAKFSAFIKNTKKDANEIHEKNLLKALRKLDNYLNSPLPDEIDAYSTEDVTVSGRKFLDGDELTLADCNLLPKLHIIKIVAKKYRDFEFPSEMTGIWRYLNNAYARDEFTNTCPADQEIEHAYSDVAKRMK

SEQ ID NO: 545 - protein, 14 aa, Homo sapiens
HVGMAVAGLLADAR

SEQ ID NO: 546 - protein, 16 aa, Homo sapiens
AFELELSWVGELTNGR

SEQ ID NO: 547 - protein, 14 aa, Homo sapiens
AAQHGMDDDGTGQK

SEQ ID NO: 548 - protein, 22 aa, Homo sapiens
AQPVQVAEGSEPDGFWEALGGK

SEQ ID NO: 549 - protein, 15 aa, Homo sapiens
DSQEEEKTEALTSAK

SEQ ID NO: 550 - protein, 34 aa, Homo sapiens
NWQGAQSTQDEVAASAILTAQLDEELGGTPVQSR

SEQ ID NO: 551 - protein, 16 aa, Homo sapiens
TAQLDEELGGTPVQSR

SEQ ID NO: 552 - protein, 26 aa, Homo sapiens
LPELAPTAPLPYPAPEASGPPAVAPR

SEQ ID NO: 553 - protein, 285 aa, Homo sapiens
MAGAGSEARFAGLSLVQLNELLEDEGQLTEMVQKMEETQNVQLNKEMTLASNRSLAEGNLLYQPQLDTLKARLTQKYQELQVLFEAYQIKKTKLDRQSSSASLETLLALLQAEGAKIEEDTENMAEKFLDGELPLDSFIDVYQSKRKLAHMRRVKIEKLQEMVLKGQRLPQALAPLPPRLPELAPTAPLPYPAPEASGPPAVAPRRIPPPPPPVPAGRLATPFTAAMSSGQAVPYPGLQCPPLPPRVGLPTQQGFSSQFVSPYPPPLPQRPPPRLPPHQPGFILQ

SEQ ID NO: 554 - protein, 30 aa, Homo sapiens
EPSAPSIPTPAYQSSPAGGHAPTPPTPAPR

SEQ ID NO: 555 - protein, 18 aa, Homo sapiens
FIQQTYPSGGEEQAQYCR

SEQ ID NO: 556 - protein, 23 aa, Homo sapiens
FLTALAQDGVINEEALSVTELDR

SEQ ID NO: 557 - protein, 11 aa, Homo sapiens
FYNELTEILVR

SEQ ID NO: 558 - protein, 10 aa, Homo sapiens
HEGALETLLR

SEQ ID NO: 559 - protein, 9 aa, Homo sapiens
LQHAAELIK

SEQ ID NO: 560 - protein, 11 aa, Homo sapiens
NIQVSHQEFSK

SEQ ID NO: 561 - protein, 17 aa, Homo sapiens
NLATAYDNFVELVANLK

SEQ ID NO: 562 - protein, 16 aa, Homo sapiens
SVIEQGGIQTVDQLIK

SEQ ID NO: 563 - protein, 7 aa, Homo sapiens
FTDLFEK

SEQ ID NO: 564 - protein, 7 aa, Homo sapiens
KQEGLLK

SEQ ID NO: 565 - protein, 8 aa, Homo sapiens
YDEYVNVK

SEQ ID NO: 566 - protein, 868 aa, Homo sapiens
MATFISVQLKKTSEVDLAKPLVKFIQQTYPSGGEEQAQYCRAAEELSKLRRAAVGRPLDKHEGALETLLRYYDQICSIEPKFPFSENQICLTFTWKDAFDKGSLFGGSVKLALASLGYEKSCVLFNCAALASQIAAEQNLDNDEGLKIAAKHYQFASGAFLHIKETVLSALSREPTVDISPDTVGTLSLIMLAQAQEVFFLKATRDKMKDAIIAKLANQAADYFGDAFKQCQYKDTLPKEVFPVLAAKHCIMQANAEYHQSILAKQQKKFGEEIARLQHAAELIKTVASRYDEYVNVKDFSDKINRALAAAKKDNDFIYHDRVPDLKDLDPIGKATLVKSTPVNVPISQKFTDLFEKMVPVSVQQSLAAYNQRKADLVNRSIAQMREATTLANGVLASLNLPAAIEDVSGDTVPQSILTKSRSVIEQGGIQTVDQLIKELPELLQRNREILDESLRLLDEEEATDNDLRAKFKERWQRTPSNELYKPLRAEGTNFRTVLDKAVQADGQVKECYQSHRDTIVLLCKPEPELNAAIPSANPAKTMQGSEVVNVLKSLLSNLDEVKKEREGLENDLKSVNFDMTSKFLTALAQDGVINEEALSVTELDRVYGGLTTKVQESLKKQEGLLKNIQVSHQEFSKMKQSNNEANLREEVLKNLATAYDNFVELVANLKEGTKFYNELTEILVRFQNKCSDIVFARKTERDELLKDLQQSIAREPSAPSIPTPAYQSSPAGGHAPTPPTPAPRTMPPTKPQPPARPPPPVLPANRAPSATAPSPVGAGTAAPAPSQTPGSAPPPQAQGPPYPTYPGYPGYCQMPMPMGYNPYAYGQYNMPYPPVYHQSPGQAPYPGPQQPSYPFPQPPQQSYYPQQ

SEQ ID NO: 567 - protein, 15 aa, Homo sapiens
EIVDSYLPVILDIIK

SEQ ID NO: 568 - protein, 11 aa, Homo sapiens
GCSFLPDPYQK

SEQ ID NO: 569 - protein, 7 aa, Homo sapiens
LVGYLDR

SEQ ID NO: 570 - protein, 9 aa, Homo sapiens
QEILAALEK

SEQ ID NO: 571 - protein, 8 aa, Homo sapiens
SLPCDICK

SEQ ID NO: 572 - protein, 524 aa, Homo sapiens
MYALFLLASLLGAALAGPVLGLKECTRGSAVWCQNVKTASDCGAVKHCLQTVWNKPTVKSLPCDICKDVVTAAGDMLKDNATEEEILVYLEKTCDWLPKPNMSASCKEIVDSYLPVILDIIKGEMSRPGEVCSALNLCESLQKHLAELNHQKQLESNKIPELDMTEVVAPFMANIPLLLYPQDGPRSKPQPKDNGDVCQDCIQMVTDIQTAVRTNSTFVQALVEHVKEECDRLGPGMADICKNYISQYSEIAIQMMMHMQPKEICALVGFCDEVKEMPMQTLVPAKVASKNVIPALELVEPIKKHEVPAKSDVYCEVCEFLVKEVTKLIDNNKTEKEILDAFDKMCSKLPKSLSEECQEVVDTYGSSILSILLEEVSPELVCSMLHLCSGTRLPALTVHVTQPKDGGFCEVCKKLVGYLDRNLEKNSTKQEILAALEKGCSFLPDPYQKQCDQFVAEYEPVLIEILVEVMDPSFVCLKIGACPSAHKPLLGTEKCIWGPSYWCQNTETAAQCNAVEHCKRHVWN

SEQ ID NO: 573 - protein, 7 aa, Homo sapiens
AAMALEK

SEQ ID NO: 574 - protein, 7 aa, Homo sapiens
ALFQDIK

SEQ ID NO: 575 - protein, 13 aa, Homo sapiens
DDVALEGVSHFFR

SEQ ID NO: 576 - protein, 9 aa, Homo sapiens
DLHALGSAR

SEQ ID NO: 577 - protein, 16 aa, Homo sapiens
FDRDDVALEGVSHFFR

SEQ ID NO: 578 - protein, 16 aa, Homo sapiens
KLNQALLDLHALGSAR

SEQ ID NO: 579 - protein, 9 aa, Homo sapiens
KPAEDEWGK

SEQ ID NO: 580 - protein, 15 aa, Homo sapiens
LCDFLETHFLDEEVK

SEQ ID NO: 581 - protein, 15 aa, Homo sapiens
LGGPEAGLGEYLFER

SEQ ID NO: 582 - protein, 19 aa, Homo sapiens
LGGPEAGLGEYLFERLTLK

SEQ ID NO: 583 - protein, 21 aa, Homo sapiens
LGGPEAGLGEYLFERLTLKHD

SEQ ID NO: 584 - protein, 15 aa, Homo sapiens
LNQALLDLHALGSAR

SEQ ID NO: 585 - protein, 10 aa, Homo sapiens
MGDHLTNLHR

SEQ ID NO: 586 - protein, 13 aa, Homo sapiens
QALLDLHALGSAR

SEQ ID NO: 587 - protein, 19 aa, Homo sapiens
TDPHLCDFLETHFLDEEVK

SEQ ID NO: 588 - protein, 6 aa, Homo sapiens
ELAEEK

SEQ ID NO: 589 - protein, 175 aa, Homo sapiens
MSSQIRQNYSTDVEAAVNSLVNLYLQASYTYLSLGFYFDRDDVALEGVSHFFRELAEEKREGYERLLKMQNQRGGRALFQDIKKPAEDEWGKTPDAMKAAMALEKKLNQALLDLHALGSARTDPHLCDFLETHFLDEEVKLIKKMGDHLTNLHRLGGPEAGLGEYLFERLTLKHD

SEQ ID NO: 590 - protein, 28 aa, Homo sapiens
AAFGQGSGPIMLDEVQCTGTEASLADCK

SEQ ID NO: 591 - protein, 20 aa, Homo sapiens
ALMLCEGLFVADVTDFEGWK

SEQ ID NO: 592 - protein, 12 aa, Homo sapiens
ASHEEVEGLVEK

SEQ ID NO: 593 - protein, 14 aa, Homo sapiens
ELSEALGQIFDSQR

SEQ ID NO: 594 - protein, 21 aa, Homo sapiens
GQWGTVCDNLWDLTDASVVCR

SEQ ID NO: 595 - protein, 9 aa, Homo sapiens
IDITLSSVK

SEQ ID NO: 596 - protein, 19 aa, Homo sapiens
IYTSPTWSAFVTDSSWSAR

SEQ ID NO: 597 - protein, 12 aa, Homo sapiens
QSFQTPQHPSFL

SEQ ID NO: 598 - protein, 16 aa, Homo sapiens
QSFQTPQHPSFLFQDK

SEQ ID NO: 599 - protein, 13 aa, Homo sapiens
QTPQHPSFLFQDK

SEQ ID NO: 600 - protein, 10 aa, Homo sapiens
RIDITLSSVK

SEQ ID NO: 601 - protein, 13 aa, Homo sapiens
SDLAVPSELALLK

SEQ ID NO: 602 - protein, 16 aa, Homo sapiens
STSSFPCPAGHFNGFR

SEQ ID NO: 603 - protein, 7 aa, Homo sapiens
TIAYENK

SEQ ID NO: 604 - protein, 12 aa, Homo sapiens
TLQALEFHTVPF

SEQ ID NO: 605 - protein, 11 aa, Homo sapiens
VADVTDFEGWK

SEQ ID NO: 606 - protein, 9 aa, Homo sapiens
WSHEALFQK

SEQ ID NO: 607 - protein, 13 aa, Homo sapiens
YSSDYFQAPSDYR

SEQ ID NO: 608 - protein, 6 aa, Homo sapiens
VEIFYR

SEQ ID NO: 609 - protein, 585 aa, Homo sapiens
MTPPRLFWVWLLVAGTQGVNDGDMRLADGGATNQGRVEIFYRGQWGTVCDNLWDLTDASVVCRALGFENATQALGRAAFGQGSGPIMLDEVQCTGTEASLADCKSLGWLKSNCRHERDAGVVCTNETRSTHTLDLSRELSEALGQIFDSQRGCDLSISVNVQGEDALGFCGHTVILTANLEAQALWKEPGSNVTMSVDAECVPMVRDLLRYFYSRRIDITLSSVKCFHKLASAYGARQLQGYCASLFAILLPQDPSFQMPLDLYAYAVATGDALLEKLCLQFLAWNFEALTQAEAWPSVPTDLLQLLLPRSDLAVPSELALLKAVDTWSWGERASHEEVEGLVEKIRFPMMLPEELFELQFNLSLYWSHEALFQKKTLQALEFHTVPFQLLARYKGLNLTEDTYKPRIYTSPTWSAFVTDSSWSARKSQLVYQSRRGPLVKYSSDYFQAPSDYRYYPYQSFQTPQHPSFLFQDKRVSWSLVYLPTIQSCWNYGFSCSSDELPVLGLTKSGGSDRTIAYENKALMLCEGLFVADVTDFEGWKAAIPSALDTNSSKSTSSFPCPAGHFNGFRTVIRPFYLTNSSGVD

SEQ ID NO: 610 - protein, 16 aa, Homo sapiens
AAQGLLACGVAQGALR

SEQ ID NO: 611 - protein, 15 aa, Homo sapiens
ALASECAQHLSLPLR

SEQ ID NO: 612 - protein, 23 aa, Homo sapiens
TLGWCDVGYNFLIGEDGLVYEGR

SEQ ID NO: 613 - protein, 196 aa, Homo sapiens
MSRRSMLLAWALPSLLRLGAAQETEDPACCSPIVPRNEWKALASECAQHLSLPLRYVVVSHTAGSSCNTPASCQQQARNVQHYHMKTLGWCDVGYNFLIGEDGLVYEGRGWNFTGAHSGHLWNPMSIGISFMGNYMDRVPTPQAIRAAQGLLACGVAQGALRSNYVLKGHRDVQRTLSPGNQLYHLIQNWPHYRSP

SEQ ID NO: 614 - protein, 9 aa, Homo sapiens
ESTLHLVLR

SEQ ID NO: 615 - protein, 16 aa, Homo sapiens
TITLEVEPSDTIENVK

SEQ ID NO: 616 - protein, 9 aa, Homo sapiens
TLSDYNIQK

SEQ ID NO: 617 - protein, 6 aa, Homo sapiens
LIFAGK

SEQ ID NO: 618 - protein, 6 aa, Homo sapiens
MQIFVK

SEQ ID NO: 619 - protein, 20 aa, Homo sapiens
LLSQQQADGSFQDPCPVLDR

SEQ ID NO: 620 - protein, 1744 aa, Homo sapiens
MRLLWGLIWASSFFTLSLQKPRLLLFSPSVVHLGVPLSVGVQLQDVPRGQVVKGSVFLRNPSRNNVPCSPKVDFTLSSERDFALLSLQVPLKDAKSCGLHQLLRGPEVQLVAHSPWLKDSLSRTTNIQGINLLFSSRRGHLFLQTDQPIYNPGQRVRYRVFALDQKMRPSTDTITVMVENSHGLRVRKKEVYMPSSIFQDDFVIPDISEPGTWKISARFSDGLESNSSTQFEVKKYVLPNFEVKITPGKPYILTVPGHLDEMQLDIQARYIYGKPVQGVAYVRFGLLDEDGKKTFFRGLESQTKLVNGQSHISLSKAEFQDALEKLNMGITDLQGLRLYVAAAIIESPGGEMEEAELTSWYFVSSPFSLDLSKTKRHLVPGAPFLLQALVREMSGSPASGIPVKVSATVSSPGSVPEVQDIQQNTDGSGQVSIPIIIPQTISELQLSVSAGSPHPAIARLTVAAPPSGGPGFLSIERPDSRPPRVGDTLNLNLRAVGSGATFSHYYYMILSRGQIVFMNREPKRTLTSVSVFVDHHLAPSFYFVAFYYHGDHPVANSLRVDVQAGACEGKLELSVDGAKQYRNGESVKLHLETDSLALVALGALDTALYAAGSKSHKPLNMGKVFEAMNSYDLGCGPGGGDSALQVFQAAGLAFSDGDQWTLSRKRLSCPKEKTTRKKRNVNFQKAINEKLGQYASPTAKRCCQDGVTRLPMMRSCEQRAARVQQPDCREPFLSCCQFAESLRKKSRDKGQAGLQRALEILQEEDLIDEDDIPVRSFFPENWLWRVETVDRFQILTLWLPDSLTTWEIHGLSLSKTKGLCVATPVQLRVFREFHLHLRLPMSVRRFEQLELRPVLYNYLDKNLTVSVHVSPVEGLCLAGGGGLAQQVLVPAGSARPVAFSVVPTAAAAVSLKVVARGSFEFPVGDAVSKVLQIEKEGAIHREELVYELNPLDHRGRTLEIPGNSDPNMIPDGDFNSYVRVTASDPLDTLGSEGALSPGGVASLLRLPRGCGEQTMIYLAPTLAASRYLDKTEQWSTLPPETKDHAVDLIQKGYMRIQQFRKADGSYAAWLSRDSSTWLTAFVLKVLSLAQEQVGGSPEKLQETSNWLLSQQQADGSFQDPCPVLDRSMQGGLVGNDETVALTAFVTIALHHGLAVFQDEGAEPLKQRVEASISKANSFLGEKASAGLLGAHAAAITAYALTLTKAPVDLLGVAHNNLMAMAQETGDNLYWGSVTGSQSNAVSPTPAPRNPSDPMPQAPALWIETTAYALLHLLLHEGKAEMADQASAWLTRQGSFQGGFRSTQDTVIALDALSAYWIASHTTEERGLNVTLSSTGRNGFKSHALQLNNRQIRGLEEELQFSLGSKINVKVGGNSKGTLKVLRTYNVLDMKNTTCQDLQIEVTVKGHVEYTMEANEDYEDYEYDELPAKDDPDAPLQPVTPLQLFEGRRNRRRREAPKVVEEQESRVHYTVCIWRNGKVGLSGMAIADVTLLSGFHALRADLEKLTSLSDRYVSHFETEGPHVLLYFDSVPTSRECVGFEAVQEVPVGLVQPASATLYDYYNPERRCSVFYGAPSKSRLLATLCSAEVCQCAEGKCPRQRRALERGLQDEDGYRMKFACYYPRVEYGFQVKVLREDSRAAFRLFETKITQVLHFTKDVKAAANQMRNFLVRASCRLRLEPGKEYLIMGLDGATYDLEGHPQYLLDSNSWIEEMPSERLCRSTRQRAACAQLNDFLQEYGTQGCQV

SEQ ID NO: 621 - protein, 17 aa, Homo sapiens
ESIAGLVVTAISEDAQR

SEQ ID NO: 622 - protein, 31 aa, Homo sapiens
QHLAHGALPVATVDRPDFYPPAYEESLEVEK

SEQ ID NO: 623 - protein, 18 aa, Homo sapiens
QHLAHGALPVATVDRPDF

SEQ ID NO: 624 - protein, 170 aa, Homo sapiens
MQNRTGLILCALALLMGFLMVCLGAFFISWGSIFDCQGSLIAAYLLLPLGFVILLSGIFWSNYRQVTESKGVLRHMLRQHLAHGALPVATVDRPDFYPPAYEESLEVEKQSCPAEREASGIPPPLYTETGLEFQDGNDSHPEAPPSYRESIAGLVVTAISEDAQRRGQEC

SEQ ID NO: 625 - protein, 27 aa, Homo sapiens
GPGQGDLELEDGDDFVSPALELSGALR

SEQ ID NO: 626 - protein, 1247 aa, Homo sapiens
MLASSSRIRAAWTRALLLPLLLAGPVGCLSRQELFPFGPGQGDLELEDGDDFVSPALELSGALRFYDRSDIDAVYVTTNGIIATSEPPAKESHPGLFPPTFGAVAPFLADLDTTDGLGKVYYREDLSPSITQRAAECVHRGFPEISFQPSSAVVVTWESVAPYQGPSRDPDQKGKRNTFQAVLASSDSSSYAIFLYPEDGLQFHTTFSKKENNQVPAVVAFSQGSVGFLWKSNGAYNIFANDRESVENLAKSSNSGQQGVWVFEIGSPATTNGVVPADVILGTEDGAEYDDEDEDYDLATTRLGLEDVGTTPFSYKALRRGGADTYSVPSVLSPRRAATERPLGPPTERTRSFQLAVETFHQQHPQVIDVDEVEETGVVFSYNTDSRQTCANNRHQCSVHAECRDYATGFCCSCVAGYTGNGRQCVAEGSPQRVNGKVKGRIFVGSSQVPIVFENTDLHSYVVMNHGRSYTAISTIPETVGYSLLPLAPVGGIIGWMFAVEQDGFKNGFSITGGEFTRQAEVTFVGHPGNLVIKQRFSGIDEHGHLTIDTELEGRVPQIPFGSSVHIEPYTELYHYSTSVITSSSTREYTVTEPERDGASPSRIYTYQWRQTITFQECVHDDSRPALPSTQQLSVDSVFVLYNQEEKILRYALSNSIGPVREGSPDALQNPCYIGTHGCDTNAACRPGPRTQFTCECSIGFRGDGRTCYDIDECSEQPSVCGSHTICNNHPGTFRCECVEGYQFSDEGTCVAVVDQRPINYCETGLHNCDIPQRAQCIYTGGSSYTCSCLPGFSGDGQACQDVDECQPSRCHPDAFCYNTPGSFTCQCKPGYQGDGFRCVPGEVEKTRCQHEREHILGAAGATDPQRPIPPGLFVPECDAHGHYAPTQCHGSTGYCWCVDRDGREVEGTRTRPGMTPPCLSTVAPPIHQGPAVPTAVIPLPPGTHLLFAQTGKIERLPLEGNTMRKTEAKAFLHVPAKVIIGLAFDCVDKMVYWTDITEPSIGRASLHGGEPTTIIRQDLGSPEGIAVDHLGRNIFWTDSNLDRIEVAKLDGTQRRVLFETDLVNPRGIVTDSVRGNLYWTDWNRDNPKIETSYMDGTNRRILVQDDLGLPNGLTFDAFSSQLCWVDAGTNRAECLNPSQPSRRKALEGLQYPFAVTSYGKNLYFTDWKMNSVVALDLAISKETDAFQPHKQTRLYGITTALSQCPQGHNYCSVNNGGCTHLCLATPGSRTCRCPDNTLGVDCIEQK

SEQ ID NO: 627 - protein, 7 aa, Homo sapiens
EVQEFYK

SEQ ID NO: 628 - protein, 14 aa, Homo sapiens
AGGVEQFISDICPK

SEQ ID NO: 629 - protein, 228 aa, Homo sapiens
MPVKGGTKCIKYLLFGFNFIFWLAGIAVLAIGLWLRFDSQTKSIFEQETNNNNSSFYTGVYILIGAGALMMLVGFLGCCGAVQESQCMLGLFFGFLLVIFAIEIAAAIWGYSHKDEVIKEVQEFYKDTYNKLKTKDEPQRETLKAIHYALNCCGLAGGVEQFISDICPKKDVLETFTVKSCPDAIKEVFDNKFHIIGAVGIGIAVVMIFGMIFSMILCCAIRRNREMV

SEQ ID NO: 630 - protein, 17 aa, Homo sapiens
ALFPDDVGCVVPSECLR

SEQ ID NO: 631 - protein, 11 aa, Homo sapiens
LVMELMPIGLR

SEQ ID NO: 632 - protein, 596 aa, Homo sapiens
MAANSTSDLHTPGTQLSVADIIVITVYFALNVAVGIWSSCRASRNTVNGYFLAGRDMTWWPIGASLFASSEGSGLFIGLAGSGAAGGLAVAGFEWNATYVLLALAWVFVPIYISSEIVTLPEYIQKRYGGQRIRMYLSVLSLLLSVFTKISLDLYAGALFVHICLGWNFYLSTILTLGITALYTIAGGLAAVIYTDALQTLIMVVGAVILTIKAFDQIGGYGQLEAAYAQAIPSRTIANTTCHLPRTDAMHMFRDPHTGDLPWTGMTFGLTIMATWYWCTDQVIVQRSLSARDLNHAKAGSILASYLKMLPMGLIIMPGMISRALFPDDVGCVVPSECLRACGAEVGCSNIAYPKLVMELMPIGLRGLMIAVMLAALMSSLTSIFNSSSTLFTMDIWRRLRPRSGERELLLVGRLVIVALIGVSVAWIPVLQDSNSGQLFIYMQSVTSSLAPPVTAVFVLGVFWRRANEQGAFWGLIAGLVVGATRLVLEFLNPAPPCGEPDTRPAVLGSIHYLHFAVALFALSGAVVVAGSLLTPPPQSVQIENLTWWTLAQDVPLGTKAGDGQTPQKHAFWARVCGFNAILLMCVNIFFYAYFA

SEQ ID NO: 633 - protein, 17 aa, Homo sapiens
APEPGPAGDGGPGAPAR

SEQ ID NO: 634 - protein, 12 aa, Homo sapiens
LVPTHTQVPVHR

SEQ ID NO: 635 - protein, 18 aa, Homo sapiens
ANVAVVSGAPLQGQLVAR

SEQ ID NO: 636 - protein, 16 aa, Homo sapiens
VAVVSGAPLQGQLVAR

SEQ ID NO: 637 - protein, 7 aa, Homo sapiens
AQLLDYK

SEQ ID NO: 638 - protein, 12 aa, Homo sapiens
ASLIDDAFALAR

SEQ ID NO: 639 - protein, 9 aa, Homo sapiens
AVHQFDSVK

SEQ ID NO: 640 - protein, 10 aa, Homo sapiens
EESVDDKWTR

SEQ ID NO: 641 - protein, 9 aa, Homo sapiens
ETNLLYDPK

SEQ ID NO: 642 - protein, 12 aa, Homo sapiens
EYGALSNMPVAK

SEQ ID NO: 643 - protein, 20 aa, Homo sapiens
IAIPDFGTGAMENWGLITYR

SEQ ID NO: 644 - protein, 10 aa, Homo sapiens
INPDHIGFYR

SEQ ID NO: 645 - protein, 12 aa, Homo sapiens
KSFPCFDEPNKK

SEQ ID NO: 646 - protein, 9 aa, Homo sapiens
LLYGLASVK

SEQ ID NO: 647 - protein, 10 aa, Homo sapiens
LPDFVNPVHY

SEQ ID NO: 648 - protein, 17 aa, Homo sapiens
NMAWNWIQLNWDYLVNR

SEQ ID NO: 649 - protein, 7 aa, Homo sapiens
NNIEWLK

SEQ ID NO: 650 - protein, 13 aa, Homo sapiens
QMGYPVLNVNGVK

SEQ ID NO: 651 - protein, 11 aa, Homo sapiens
SFPCFDEPNKK

SEQ ID NO: 652 - protein, 13 aa, Homo sapiens
SIVATDHEPTDAR

SEQ ID NO: 653 - protein, 24 aa, Homo sapiens
SSHPIIVTVTTPDEITSVFDGISY

SEQ ID NO: 654 - protein, 13 aa, Homo sapiens
TSDFWAALEEASR

SEQ ID NO: 655 - protein, 17 aa, Homo sapiens
TSDFWAALEEASRLPVK

SEQ ID NO: 656 - protein, 7 aa, Homo sapiens
YLWLHLR

SEQ ID NO: 657 - protein, 11 aa, Homo sapiens
YPQAGAGEKPR

SEQ ID NO: 658 - protein, 13 aa, Homo sapiens
MLEDWIKPENFQK

SEQ ID NO: 659 - protein, 11 aa, Homo sapiens
IQLNWDYLVNR

SEQ ID NO: 660 - protein, 6 aa, Homo sapiens
YLDLLK

SEQ ID NO: 661 - protein, 8 aa, Homo sapiens
QMESFFAK

SEQ ID NO: 662 - protein, 957 aa, Homo sapiens
MNFAEREGSKRYCIQTKHVAILCAVVVGVGLIVGLAVGLTRSCDSSGDGGPGTAPAPSHLPSSTASPSGPPAQDQDICPASEDESGQWKNFRLPDFVNPVHYDLHVKPLLEEDTYTGTVSISINLSAPTRYLWLHLRETRITRLPELKRPSGDQVQVRRCFEYKKQEYVVVEAEEELTPSSGDGLYLLTMEFAGWLNGSLVGFYRTTYTENGQVKSIVATDHEPTDARKSFPCFDEPNKKATYTISITHPKEYGALSNMPVAKEESVDDKWTRTTFEKSVPMSTYLVCFAVHQFDSVKRISNSGKPLTIYVQPEQKHTAEYAANITKSVFDYFEEYFAMNYSLPKLDKIAIPDFGTGAMENWGLITYRETNLLYDPKESASSNQQRVATVVAHELVHQWFGNIVTMDWWEDLWLNEGFASFFEFLGVNHAETDWQMRDQMLLEDVLPVQEDDSLMSSHPIIVTVTTPDEITSVFDGISYSKGSSILRMLEDWIKPENFQKGCQMYLEKYQFKNAKTSDFWAALEEASRLPVKEVMDTWTRQMGYPVLNVNGVKNITQKRFLLDPRANPSQPPSDLGYTWNIPVKWTEDNITSSVLFNRSEKEGITLNSSNPSGNAFLKINPDHIGFYRVNYEVATWDSIATALSLNHKTFSSADRASLIDDAFALARAQLLDYKVALNLTKYLKREENFLPWQRVISAVTYIISMFEDDKELYPMIEEYFQGQVKPIADSLGWNDAGDHVTKLLRSSVLGFACKMGDREALNNASSLFEQWLNGTVSLPVNLRLLVYRYGMQNSGNEISWNYTLEQYQKTSLAQEKEKLLYGLASVKNVTLLSRYLDLLKDTNLIKTQDVFTVIRYISYNSYGKNMAWNWIQLNWDYLVNRYTLNNRNLGRIVTIAEPFNTELQLWQMESFFAKYPQAGAGEKPREQVLETVKNNIEWLKQHRNTIREWFFNLLESG

SEQ ID NO: 663 - protein, 8 aa, Homo sapiens
VFLENVIR

SEQ ID NO: 664 - protein, 15 aa, Homo sapiens
VADPAYLPTQQDVLR

SEQ ID NO: 665 - protein, 19 aa, Homo sapiens
VPTTGIIEYPFDLQSVIFR

SEQ ID NO: 666 - protein, 359 aa, Homo sapiens
MTLESIMACCLSEEAKEARRINDEIERQLRRDKRDARRELKLLLLGTGESGKSTFIKQMRIIHGSGYSDEDKRGFTKLVYQNIFTAMQAMIRAMDTLKIPYKYEHNKAHAQLVREVDVEKVSAFENPYVDAIKSLWNDPGIQECYDRRREYQLSDSTKYYLNDLDRVADPAYLPTQQDVLRVRVPTTGIIEYPFDLQSVIFRMVDVGGQRSERRKWIHCFENVTSIMFLVALSEYDQVLVESDNENRMEESKALFRTIITYPWFQNSSVILFLNKKDLLEEKIMYSHLVDYFPEYDGPQRDAQAAREFILKMFVDLNPDSDKIIYSHFTCATDTENIRFVFAAVKDTILQLNLKEYNLV

SEQ ID NO: 667 - protein, 17 aa, Homo sapiens
EGEAVVLPEVEPGLTAR

SEQ ID NO: 668 - protein, 19 aa, Homo sapiens
NQSPVDQGATGASQGLLDR

SEQ ID NO: 669 - protein, 9 aa, Homo sapiens
DIVQFVPFR

SEQ ID NO: 670 - protein, 16 aa, Homo sapiens
LYGPTNFSPIINHVAR

SEQ ID NO: 671 - protein, 17 aa, Homo sapiens
VLLIITDGVITDLDETR

SEQ ID NO: 672 - protein, 537 aa, Homo sapiens
MAAQCVTKVALNVSCANLLDKDIGSKSDPLCVLFLNTSGQQWYEVERTERIKNCLNPQFSKTFIIDYYFEVVQKLKFGVYDIDNKTIELSDDDFLGECECTLGQIVSSKKLTRPLVMKTGRPAGKGSITISAEEIKDNRVVLFEMEARKLDNKDLFGKSDPYLEFHKQTSDGNWLMVHRTEVVKNNLNPVWRPFKISLNSLCYGDMDKTIKVECYDYDNDGSHDLIGTFQTTMTKLKEASRSSPVEFECINEKKRQKKKSYKNSGVISVKQCEITVECTFLDYIMGGCQLNFTVGVDFTGSNGDPRSPDSLHYISPNGVNEYLTALWSVGLVIQDYDADKMFPAFGFGAQIPPQWQVSHEFPMNFNPSNPYCNGIQGIVEAYRSCLPQIKLYGPTNFSPIINHVARFAAAATQQQTASQYFVLLIITDGVITDLDETRQAIVNASRLPMSIIIVGVGGADFSAMEFLDGDGGSLRSPLGEVAIRDIVQFVPFRQFQNAPKEALAQCVLAEIPQQVVGYFNTYKLLPPKNPATKQQKQ

SEQ ID NO: 673 - protein, 17 aa, Homo sapiens
DENQSINHQMAQEDAQR

SEQ ID NO: 674 - protein, 16 aa, Homo sapiens
GFGTDEQAIVDVVANR

SEQ ID NO: 675 - protein, 9 aa, Homo sapiens
VLIEILCTR

SEQ ID NO: 676 - protein, 18 aa, Homo sapiens
CNFDVLEIYGGPDFHSPR

SEQ ID NO: 677 - protein, 16 aa, Homo sapiens
DFVEILDGGHEDAPLR

SEQ ID NO: 678 - protein, 17 aa, Homo sapiens
EQLANPIVSSGNSLFLR

SEQ ID NO: 679 - protein, 12 aa, Homo sapiens
LQVLLLTDGVGR

SEQ ID NO: 680 - protein, 20 aa, Homo sapiens
NGGSPESPIIGQYCGNSNPR

SEQ ID NO: 681 - protein, 18 aa, Homo sapiens
SPENPMQVSSTGNELAIR

SEQ ID NO: 682 - protein, 12 aa, Homo sapiens
SPFFPNVYPGER

SEQ ID NO: 683 - protein, 19 aa, Homo sapiens
VPGQSGVVESIGHPTLPYR

SEQ ID NO: 684 - protein, 15 aa, Homo sapiens
LNDEDLSECLHQIQK

SEQ ID NO: 685 - protein, 20 aa, Homo sapiens
YCGNTIPDSIDTSSNTAVVR

SEQ ID NO: 686 - protein, 3623 aa, Homo sapiens
MMNMSLPFLWSLLTLLIFAEVNGEAGELELQRQKRSINLQQPRMATERGNLVFLTGSAQNIEFRTGSLGKIKLNDEDLSECLHQIQKNKEDIIELKGSAIGLPQNISSQIYQLNSKLVDLERKFQGLQQTVDKKVCSSNPCQNGGTCLNLHDSFFCICPPQWKGPLCSADVNECEIYSGTPLSCQNGGTCVNTMGSYSCHCPPETYGPQCASKYDDCEGGSVARCVHGICEDLMREQAGEPKYSCVCDAGWMFSPNSPACTLDRDECSFQPGPCSTLVQCFNTQGSFYCGACPTGWQGNGYICEDINECEINNGGCSVAPPVECVNTPGSSHCQACPPGYQGDGRVCTLTDICSVSNGGCHPDASCSSTLGSLPLCTCLPGYTGNGYGPNGCVQLSNICLSHPCLNGQCIDTVSGYFCKCDSGWTGVNCTENINECLSNPCLNGGTCVDGVDSFSCECTRLWTGALCQVPQQVCGESLSGINGSFSYRSPDVGYVHDVNCFWVIKTEMGKVLRITFTFFRLESMDNCPHEFLQVYDGDSSSAFQLGRFCGSSLPHELLSSDNALYFHLYSEHLRNGRGFTVRWETQQPECGGILTGPYGSIKSPGYPGNYPPGRDCVWIVVTSPDLLVTFTFGTLSLEHHDDCNKDYLEIRDGPLYQDPLLGKFCTTFSVPPLQTTGPFARIHFHSDSQISDQGFHITYLTSPSDLRCGGNYTDPEGELFLPELSGPFTHTRQCVYMMKQPQGEQIQINFTHVELQCQSDSSQNYIEVRDGETLLGKVCGNGTISHIKSITNSVWIRFKIDASVEKASFRAVYQVACGDELTGEGVIRSPFFPNVYPGERTCRWTIHQPQSQVILLNFTVFEIGSSAHCETDYVEIGSSSILGSPENKKYCGTDIPSFITSVYNFLYVTFVKSSSTENHGFMAKFSAEDLACGEILTESTGTIQSPGHPNVYPHGINCTWHILVQPNHLIHLMFETFHLEFHYNCTNDYLEVYDTDSETSLGRYCGKSIPPSLTSSGNSLMLVFVTDSDLAYEGFLINYEAISAATACLQDYTDDLGTFTSPNFPNNYPNNWECIYRITVRTGQLIAVHFTNFSLEEAIGNYYTDFLEIRDGGYEKSPLLGIFYGSNLPPTIISHSNKLWLKFKSDQIDTRSGFSAYWDGSSTGCGGNLTTSSGTFISPNYPMPYYHSSECYWWLKSSHGSAFELEFKDFHLEHHPNCTLDYLAVYDGPSSNSHLLTQLCGDEKPPLIRSSGDSMFIKLRTDEGQQGRGFKAEYRQTCENVVIVNQTYGILESIGYPNPYSENQHCNWTIRATTGNTVNYTFLAFDLEHHINCSTDYLELYDGPRQMGRYCGVDLPPPGSTTSSKLQVLLLTDGVGRREKGFQMQWFVYGCGGELSGATGSFSSPGFPNRYPPNKECIWYIRTDPGSSIQLTIHDFDVEYHSRCNFDVLEIYGGPDFHSPRIAQLCTQRSPENPMQVSSTGNELAIRFKTDLSINGRGFNASWQAVTGGCGGIFQAPSGEIHSPNYPSPYRSNTDCSWVIRVDRNHRVLLNFTDFDLEPQDSCIMAYDGLSSTMSRLARTCGREQLANPIVSSGNSLFLRFQSGPSRQNRGFRAQFRQACGGHILTSSFDTVSSPRFPANYPNNQNCSWIIQAQPPLNHITLSFTHFELERSTTCARDFVEILDGGHEDAPLRGRYCGTDMPHPITSFSSALTLRFVSDSSISAGGFHTTVTASVSACGGTFYMAEGIFNSPGYPDIYPPNVECVWNIVSSPGNRLQLSFISFQLEDSQDCSRDFVEIREGNATGHLVGRYCGNSFPLNYSSIVGHTLWVRFISDGSGSGTGFQATFMKIFGNDNIVGTHGKVASPFWPENYPHNSNYQWTVNVNASHVVHGRILEMDIEEIQNCYYDKLRIYDGPSIHARLIGAYCGTQTESFSSTGNSLTFHFYSDSSISGKGFLLEWFAVDAPDGVLPTIAPGACGGFLRTGDAPVFLFSPGWPDSYSNRVDCTWLIQAPDSTVELNILSLDIESHRTCAYDSLVIRDGDNNLAQQLAVLCGREIPGPIRSTGEYMFIRFTSDSSVTRAGFNASFHKSCGGYLHADRGIITSPKYPETYPSNLNCSWHVLVQSGLTIAVHFEQPFQIPNGDSSCNQGDYLVLRNGPDICSPPLGPPGGNGHFCGSHASSTLFTSDNQMFVQFISDHSNEGQGFKIKYEAKSLACGGNVYIHDADSAGYVTSPNHPHNYPPHADCIWILAAPPETRIQLQFEDRFDIEVTPNCTSNYLELRDGVDSDAPILSKFCGTSLPSSQWSSGEVMYLRFRSDNSPTHVGFKAKYSIAQCGGRVPGQSGVVESIGHPTLPYRDNLFCEWHLQGLSGHYLTISFEDFNLQNSSGCEKDFVEIWDNHTSGNILGRYCGNTIPDSIDTSSNTAVVRFVTDGSVTASGFRLRFESSMEECGGDLQGSIGTFTSPNYPNPNPHGRICEWRITAPEGRRITLMFNNLRLATHPSCNNEHVIVFNGIRSNSPQLEKLCSSVNVSNEIKSSGNTMKVIFFTDGSRPYGGFTASYTSSEDAVCGGSLPNTPEGNFTSPGYDGVRNYSRNLNCEWTLSNPNQGNSSISIHFEDFYLESHQDCQFDVLEFRVGDADGPLMWRLCGPSKPTLPLVIPYSQVWIHFVTNERVEHIGFHAKYSFTDCGGIQIGDSGVITSPNYPNAYDSLTHCSSLLEAPQGHTITLTFSDFDIEPHTTCAWDSVTVRNGGSPESPIIGQYCGNSNPRTIQSGSNQLVVTFNSDHSLQGGGFYATWNTQTLGCGGIFHSDNGTIRSPHWPQNFPENSRCSWTAITHKSKHLEISFDNNFLIPSGDGQCQNSFVKVWAGTEEVDKALLATGCGNVAPGPVITPSNTFTAVFQSQEAPAQGFSASFVSRCGSNFTGPSGYIISPNYPKQYDNNMNCTYVIEANPLSVVLLTFVSFHLEARSAVTGSCVNDGVHIIRGYSVMSTPFATVCGDEMPAPLTIAGPVLLNFYSNEQITDFGFKFSYRIISCGGVFNFSSGIITSPAYSYADYPNDMHCLYTITVSDDKVIELKFSDFDVVPSTSCSHDYLAIYDGANTSDPLLGKFCGSKRPPNVKSSNNSMLLVFKTDSFQTAKGWKMSFRQTLGPQQGCGGYLTGSNNTFASPDSDSNGMYDKNLNCVWIIIAPVNKVIHLTFNTFALEAASTRQRCLYDYVKLYDGDSENANLAGTFCGSTVPAPFISSGNFLTVQFISDLTLEREGFNATYTIMDMPCGGTYNATWTPQNISSPNSSDPDVPFSICTWVIDSPPHQQVKITVWALQLTSQDCTQNYLQLQDSPQGHGNSRFQFCGRNASAVPVFYSSMSTAMVIFKSGVVNRNSRMSFTYQIADCNRDYHKAFGNLRSPGWPDNYDNDKDCTVTLTAPQNHTISLFFHSLGIENSVECRNDFLEVRNGSNSNSPLLGKYCGTLLPNPVFSQNNELYLRFKSDSVTSDRGYEIIWTSSPSGCGGTLYGDRGSFTSPGYPGTYPNNTYCEWVLVAPAGRLVTINFYFISIDDPGDCVQNYLTLYDGPNASSPSSGPYCGGDTSIAPFVASSNQVFIKFHADYARRPSAFRLTWDS

SEQ ID NO: 687 - protein, 15 aa, Homo sapiens
SHLVDYFPEFDGPQR

SEQ ID NO: 688 - protein, 19 aa, Homo sapiens
VPTTGIIEYPFDLENIIFR

SEQ ID NO: 689 - protein, 359 aa, Homo sapiens
MTLESMMACCLSDEVKESKRINAEIEKQLRRDKRDARRELKLLLLGTGESGKSTFIKQMRIIHGAGYSEEDKRGFTKLVYQNIFTAMQAMIRAMETLKILYKYEQNKANALLIREVDVEKVTTFEHQYVSAIKTLWEDPGIQECYDRRREYQLSDSAKYYLTDVDRIATLGYLPTQQDVLRVRVPTTGIIEYPFDLENIIFRMVDVGGQRSERRKWIHCFENVTSIMFLVALSEYDQVLVESDNENRMEESKALFRTIITYPWFQNSSVILFLNKKDLLEDKILYSHLVDYFPEFDGPQRDAQAAREFILKMFVDLNPDSDKIIYSHFTCATDTENIRFVFAAVKDTILQLNLKEYNLV

SEQ ID NO: 690 - protein, 22 aa, Homo sapiens
DLEFTIYDDDDVSPFLEGLEER

SEQ ID NO: 691 - protein, 20 aa, Homo sapiens
ILHVDNHIGISIAGLTADAR

SEQ ID NO: 692 - protein, 25 aa, Homo sapiens
DLEFTIYDDDDVSPFLEGLEERPQR

SEQ ID NO: 693 - protein, 18 aa, Homo sapiens
FCGLPQPETVGQLGTVLR

SEQ ID NO: 694 - protein, 12 aa, Homo sapiens
FPTDQLTPDQER

SEQ ID NO: 695 - protein, 12 aa, Homo sapiens
IGLDLPALNMQR

SEQ ID NO: 696 - protein, 12 aa, Homo sapiens
IVGAMVQIITYR

SEQ ID NO: 697 - protein, 14 aa, Homo sapiens
NIDIWMGGVSEPLK

SEQ ID NO: 698 - protein, 24 aa, Homo sapiens
NQINALTSFVDASMVYGSEEPLAR

SEQ ID NO: 699 - protein, 10 aa, Homo sapiens
QALAQISLPR

SEQ ID NO: 700 - protein, 12 aa, Homo sapiens
VVLEGGIDPILR

SEQ ID NO: 701 - protein, 14 aa, Homo sapiens
VGPLLACIIGTQFR

SEQ ID NO: 702 - protein, 745 aa, Homo sapiens
MGVPFFSSLRCMVDLGPCWAGGLTAEMKLLLALAGLLAILATPQPSEGAAPAVLGEVDTSLVLSSMEEAKQLVDKAYKERRESIKQRLRSGSASPMELLSYFKQPVAATRTAVRAADYLHVALDLLERKLRSLWRRPFNVTDVLTPAQLNVLSKSSGCAYQDVGVTCPEQDKYRTITGMCNNRRSPTLGASNRAFVRWLPAEYEDGFSLPYGWTPGVKRNGFPVALARAVSNEIVRFPTDQLTPDQERSLMFMQWGQLLDHDLDFTPEPAARASFVTGVNCETSCVQQPPCFPLKIPPNDPRIKNQADCIPFFRSCPACPGSNITIRNQINALTSFVDASMVYGSEEPLARNLRNMSNQLGLLAVNQRFQDNGRALLPFDNLHDDPCLLTNRSARIPCFLAGDTRSSEMPELTSMHTLLLREHNRLATELKSLNPRWDGERLYQEARKIVGAMVQIITYRDYLPLVLGPTAMRKYLPTYRSYNDSVDPRIANVFTNAFRYGHTLIQPFMFRLDNRYQPMEPNPRVPLSRVFFASWRVVLEGGIDPILRGLMATPAKLNRQNQIAVDEIRERLFEQVMRIGLDLPALNMQRSRDHGLPGYNAWRRFCGLPQPETVGQLGTVLRNLKLARKLMEQYGTPNNIDIWMGGVSEPLKRKGRVGPLLACIIGTQFRKLRDGDRFWWENEGVFSMQQRQALAQISLPRIICDNTGITTVSKNNIFMSNSYPRDFVNCSTLPALNLASWREAS

SEQ ID NO: 703 - protein, 11 aa, Homo sapiens
EDFLSNFDIFK

SEQ ID NO: 704 - protein, 26 aa, Homo sapiens
SHPVEDGGTDNPAFNHIELNSDQSGK

SEQ ID NO: 705 - protein, 14 aa, Homo sapiens
HFCPNVPIILVGNK

SEQ ID NO: 706 - protein, 17 aa, Homo sapiens
QVELALWDTAGQEDYDR

SEQ ID NO: 707 - protein, 18 aa, Homo sapiens
EQVQSCGPPPELLNGNVK

SEQ ID NO: 708 - protein, 11 aa, Homo sapiens
KGEWVALNPLR

SEQ ID NO: 709 - protein, 9 aa, Homo sapiens
LIILEEHLK

SEQ ID NO: 710 - protein, 10 aa, Homo sapiens
RPYFPVAVGK

SEQ ID NO: 711 - protein, 16 aa, Homo sapiens
SCDNPYIPNGDYSPLR

SEQ ID NO: 712 - protein, 12 aa, Homo sapiens
SSNLIILEEHLK

SEQ ID NO: 713 - protein, 15 aa, Homo sapiens
TCNEGYQLLGEINYR

SEQ ID NO: 714 - protein, 18 aa, Homo sapiens
TDCLSLPSFENAIPMGEK

SEQ ID NO: 715 - protein, 1231 aa, Homo sapiens
MRLLAKIICLMLWAICVAEDCNELPPRRNTEILTGSWSDQTYPEGTQAIYKCRPGYRSLGNVIMVCRKGEWVALNPLRKCQKRPCGHPGDTPFGTFTLTGGNVFEYGVKAVYTCNEGYQLLGEINYRECDTDGWTNDIPICEVVKCLPVTAPENGKIVSSAMEPDREYHFGQAVRFVCNSGYKIEGDEEMHCSDDGFWSKEKPKCVEISCKSPDVINGSPISQKIIYKENERFQYKCNMGYEYSERGDAVCTESGWRPLPSCEEKSCDNPYIPNGDYSPLRIKHRTGDEITYQCRNGFYPATRGNTAKCTSTGWIPAPRCTLKPCDYPDIKHGGLYHENMRRPYFPVAVGKYYSYYCDEHFETPSGSYWDHIHCTQDGWSPAVPCLRKCYFPYLENGYNQNHGRKFVQGKSIDVACHPGYALPKAQTTVTCMENGWSPTPRCIRVKTCSKSSIDIENGFISESQYTYALKEKAKYQCKLGYVTADGETSGSITCGKDGWSAQPTCIKSCDIPVFMNARTKNDFTWFKLNDTLDYECHDGYESNTGSTTGSIVCGYNGWSDLPICYERECELPKIDVHLVPDRKKDQYKVGEVLKFSCKPGFTIVGPNSVQCYHFGLSPDLPICKEQVQSCGPPPELLNGNVKEKTKEEYGHSEVVEYYCNPRFLMKGPNKIQCVDGEWTTLPVCIVEESTCGDIPELEHGWAQLSSPPYYYGDSVEFNCSESFTMIGHRSITCIHGVWTQLPQCVAIDKLKKCKSSNLIILEEHLKNKKEFDHNSNIRYRCRGKEGWIHTVCINGRWDPEVNCSMAQIQLCPPPPQIPNSHNMTTTLNYRDGEKVSVLCQENYLIQEGEEITCKDGRWQSIPLCVEKIPCSQPPQIEHGTINSSRSSQESYAHGTKLSYTCEGGFRISEENETTCYMGKWSSPPQCEGLPCKSPPEISHGVVAHMSDSYQYGEEVTYKCFEGFGIDGPAIAKCLGEKWSHPPSCIKTDCLSLPSFENAIPMGEKKDVYKAGEQVTYTCATYYKMDGASNVTCINSRWTGRPTCRDTSCVNPPTVQNAYIVSRQMSKYPSGERVRYQCRSPYEMFGDEEVMCLNGNWTEPPQCKDSTGKCGPPPPIDNGDITSFPLSVYAPASSVEYQCQNLYQLEGNKRITCRNGQWSEPPKCLHPCVISREIMENYNIALRWTAKQKLYSRTGESVEFVCKRGYRLSSRSHTLRTTCWDGKLEYPTCAKR

SEQ ID NO: 716 - protein, 13 aa, Homo sapiens
AQQVAVQEQEIAR

SEQ ID NO: 717 - protein, 14 aa, Homo sapiens
DIHDDQDYLHSLGK

SEQ ID NO: 718 - protein, 17 aa, Homo sapiens
LPQVAEEISGPLTSANK

SEQ ID NO: 719 - protein, 18 aa, Homo sapiens
TEAEIAHIALETLEGHQR

SEQ ID NO: 720 - protein, 11 aa, Homo sapiens
VTGEVLDILTR

SEQ ID NO: 721 - protein, 15 aa, Homo sapiens
LTGVSISQVNHKPLR

SEQ ID NO: 722 - protein, 12 aa, Homo sapiens
VFVLPCIQQIQR

SEQ ID NO: 723 - protein, 427 aa, Homo sapiens
MFFTCGPNEAMVVSGFCRSPPVMVAGGRVFVLPCIQQIQRISLNTLTLNVKSEKVYTRHGVPISVTGIAQVKIQGQNKEMLAAACQMFLGKTEAEIAHIALETLEGHQRAIMAHMTVEEIYKDRQKFSEQVFKVASSDLVNMGISVVSYTLKDIHDDQDYLHSLGKARTAQVQKDARIGEAEAKRDAGIREAKAKQEKVSAQYLSEIEMAKAQRDYELKKAAYDIEVNTRRAQADLAYQLQVAKTKQQIEEQRVQVQVVERAQQVAVQEQEIARREKELEARVRKPAEAERYKLERLAEAEKSQLIMQAEAEAASVRMRGEAEAFAIGARARAEAEQMAKKAEAFQLYQEAAQLDMLLEKLPQVAEEISGPLTSANKITLVSSGSGTMGAAKVTGEVLDILTRLPESVERLTGVSISQVNHKPLRTA

SEQ ID NO: 724 - protein, 15 aa, Homo sapiens
TLKPQPQQLQQNLPK

SEQ ID NO: 725 - protein, 123 aa, Homo sapiens
MGNRVCCGGSWSCPSTFQKKKKTGSQTRRTLKPQPQQLQQNLPKGHETTGHTYERVLQQQGSQERSPGLMSEDSNLHYADIQVCSRPHAREVKHVHLENATEYATLRFPQATPRYDSKNGTLV

SEQ ID NO: 726 - protein, 29 aa, Homo sapiens
SVTVVTIPAEQQPLQGGAPQEAVEEEQDR

SEQ ID NO: 727 - protein, 203 aa, Homo sapiens
METLSQDSLLECQICFNYYSPRRRPKLLDCKHTCCSVCLQQMRTSQKDVRCPWCRGVTKLPPGFSVSQLPDDPEVLAVIAIPHTSEHTPVFIKLPSNGCYMLPLPISKERALLPGDMGCRLLPGSQQKSVTVVTIPAEQQPLQGGAPQEAVEEEQDRRGVVKSSTWSGVCTVILVACVLVFLLGIVLHNMSCISKRFTVISCG

SEQ ID NO: 728 - protein, 23 aa, Homo sapiens
QPPGVPNGPSSPTNESAPELPQR

SEQ ID NO: 729 - protein, 14 aa, Homo sapiens
TPAGPPPPPPPPLR

SEQ ID NO: 730 - protein, 440 aa, Homo sapiens
MPIPPPPPPPPGPPPPPTFHQANTEQPKLSRDEQRGRGALLQDICKGTKLKKVTNINDRSAPILEKPKGSSGGYGSGGAALQPKGGLFQGGVLKLRPVGAKDGSENLAGKPALQIPSSRAAAPRPPVSAASGRPQDDTDSSRASLPELPRMQRPSLPDLSRPNTTSSTGMKHSSSAPPPPPPGRRANAPPTPLPMHSSKAPAYNREKPLPPTPGQRLHPGREGPPAPPPVKPPPSPVNIRTGPSGQSLAPPPPPYRQPPGVPNGPSSPTNESAPELPQRHNSLHRKTPGPVRGLAPPPPTSASPSLLSNRPPPPARDPPSRGAAPPPPPPVIRNGARDAPPPPPPYRMHGSEPPSRGKPPPPPSRTPAGPPPPPPPPLRNGHRDSITTVRSFLDDFESKYSFHPVEDFPAPEEYKHFQRIYPSKTNRAARGAPPLPPILR

SEQ ID NO: 731 - protein, 9 aa, Homo sapiens
LQSEVAELK

SEQ ID NO: 732 - protein, 7 aa, Homo sapiens
YLIEIAK

SEQ ID NO: 733 - protein, 14 aa, Homo sapiens
KEIADYLAAGKDER

SEQ ID NO: 734 - protein, 360 aa, Homo sapiens
MLGSGFKAERLRVNLRLVINRLKLLEKKKTELAQKARKEIADYLAAGKDERARIRVEHIIREDYLVEAMEILELYCDLLLARFGLIQSMKELDSGLAESVSTLIWAAPRLQSEVAELKIVADQLCAKYSKEYGKLCRTNQIGTVNDRLMHKLSVEAPPKILVERYLIEIAKNYNVPYEPDSVVMAEAPPGVETDLIDVGFTDDVKKGGPGRGGSGGFTAPVGGPDGTVPMPMPMPMPMPSANTPFSYPLPKGPSDFNGLPMGTYQAFPNIHPPQIPATPPSYESMTLMLIRISLLHRLLVLDPSQKPLQSFLPDLQITMTTLSYQSCHLCQTHYQLHLLVPAPQHLKTLTLMIFPGGLKS

SEQ ID NO: 735 - protein, 13 aa, Homo sapiens
ELLAVACEQFLGK

SEQ ID NO: 736 - protein, 14 aa, Homo sapiens
IGEAEAAVIEAMGK

SEQ ID NO: 737 - protein, 12 aa, Homo sapiens
NVVLQTLEGHLR

SEQ ID NO: 738 - protein, 11 aa, Homo sapiens
QIAVEAQEILR

SEQ ID NO: 739 - protein, 15 aa, Homo sapiens
SILGTLTVEQIYQDR

SEQ ID NO: 740 - protein, 14 aa, Homo sapiens
TAEAQLAYELQGAR

SEQ ID NO: 741 - protein, 14 aa, Homo sapiens
MALVLEALPQIAAK

SEQ ID NO: 742 - protein, 9 aa, Homo sapiens
RPAEAEAHR

SEQ ID NO: 743 - protein, 428 aa, Homo sapiens
MGNCHTVGPNEALVVSGGCCGSDYKQYVFGGWAWAWWCISDTQRISLEIMTLQPRCEDVETAEGVALTVTGVAQVKIMTEKELLAVACEQFLGKNVQDIKNVVLQTLEGHLRSILGTLTVEQIYQDRDQFAKLVREVAAPDVGRMGIEILSFTIKDVYDKVDYLSSLGKTQTAVVQRDADIGVAEAERDAGIREAECKKEMLDVKFMADTKIADSKRAFELQKSAFSEEVNIKTAEAQLAYELQGAREQQKIRQEEIEIEVVQRKKQIAVEAQEILRTDKELIATVRRPAEAEAHRIQQIAEGEKVKQVLLAQAEAEKIRKIGEAEAAVIEAMGKAEAERMKLKAEAYQKYGDAAKMALVLEALPQIAAKIAAPLTKVDEIVVLSGDNSKVTSEVNRLLAELPASVHALTGVDLSKIPLIKKATGVQV

SEQ ID NO: 744 - protein, 18 aa, Homo sapiens
APGEGPQVACTGPPSAPR

SEQ ID NO: 745 - protein, 976 aa, Homo sapiens
MERRWPLGLGLVLLLCAPLPPGARAKEVTLMDTSKAQGELGWLLDPPKDGWSEQQQILNGTPLYMYQDCPMQGRRDTDHWLRSNWIYRGEEASRVHVELQFTVRDCKSFPGGAGPLGCKETFNLLYMESDQDVGIQLRRPLFQKVTTVAADQSFTIRDLASGSVKLNVERCSLGRLTRRGLYLAFHNPGACVALVSVRVFYQRCPETLNGLAQFPDTLPGPAGLVEVAGTCLPHARASPRPSGAPRMHCSPDGEWLVPVGRCHCEPGYEEGGSGEACVACPSGSYRMDMDTPHCLTCPQQSTAESEGATICTCESGHYRAPGEGPQVACTGPPSAPRNLSFSASGTQLSLRWEPPADTGGRQDVRYSVRCSQCQGTAQDGGPCQPCGVGVHFSPGARGLTTPAVHVNGLEPYANYTFNVEAQNGVSGLGSSGHASTSVSISMGHAESLSGLSLRLVKKEPRQLELTWAGSRPRSPGANLTYELHVLNQDEERYQMVLEPRVLLTELQPDTTYIVRVRMLTPLGPGPFSPDHEFRTSPPVSRGLTGGEIVAVIFGLLLGAALLLGILVFRSRRAQRQRQQRQRDRATDVDREDKLWLKPYVDLQAYEDPAQGALDFTRELDPAWLMVDTVIGEGEFGEVYRGTLRLPSQDCKTVAIKTLKDTSPGGQWWNFLREATIMGQFSHPHILHLEGVVTKRKPIMIITEFMENGALDAFLREREDQLVPGQLVAMLQGIASGMNYLSNHNYVHRDLAARNILVNQNLCCKVSDFGLTRLLDDFDGTYETQGGKIPIRWTAPEAIAHRIFTTASDVWSFGIVMWEVLSFGDKPYGEMSNQEVMKSIEDGYRLPPPVDCPAPLYELMKNCWAYDRARRPHFQKLQAHLEQLLANPHSLRTIANFDPRMTLRLPSLSGSDGIPYRTVSEWLESIRMKRYILHFHSAGLDTMECVLELTAEDLTQMGITLPGHQKRILCSIQGFKD

SEQ ID NO: 746 - protein, 18 aa, Homo sapiens
LYIGLAGLATDVQTVAQR

SEQ ID NO: 747 - protein, 205 aa, Homo sapiens
MSIMSYNGGAVMAMKGKNCVAIAADRRFGIQAQMVTTDFQKIFPMGDRLYIGLAGLATDVQTVAQRLKFRLNLYELKEGRQIKPYTLMSMVANLLYEKRFGPYYTEPVIAGLDPKTFKPFICSLDLIGCPMVTDDFVVSGTCAEQMYGMCESLWEPNMDPDHLFETISQAMLNAVDRDAVSGMGVIVHIIEKDKITTRTLKARMD

SEQ ID NO: 748 - protein, 18 aa, Homo sapiens
AIGAVPLIQGEYMIPCEK

SEQ ID NO: 749 - protein, 16 aa, Homo sapiens
AYWQVHLDQVEVASGL

SEQ ID NO: 750 - protein, 18 aa, Homo sapiens
DPDAQPGGELMLGGTDSK

SEQ ID NO: 751 - protein, 22 aa, Homo sapiens
EGCEAIVDTGTSLMVGPVDEVR

SEQ ID NO: 752 - protein, 17 aa, Homo sapiens
ISVNNVLPVFDNLMQQK

SEQ ID NO: 753 - protein, 11 aa, Homo sapiens
LLDIACWIHHK

SEQ ID NO: 754 - protein, 9 aa, Homo sapiens
MVGPVDEVR

SEQ ID NO: 755 - protein, 8 aa, Homo sapiens
QVFGEATK

SEQ ID NO: 756 - protein, 19 aa, Homo sapiens
TVVFDTGSSNLWVPSIHCK

SEQ ID NO: 757 - protein, 10 aa, Homo sapiens
VSTLPAITLK

SEQ ID NO: 758 - protein, 10 aa, Homo sapiens
WILGDVFIGR

SEQ ID NO: 759 - protein, 11 aa, Homo sapiens
FDGILGMAYPR

SEQ ID NO: 760 - protein, 20 aa, Homo sapiens
AYWQVHLDQVEVASGLTLCK

SEQ ID NO: 761 - protein, 6 aa, Homo sapiens
VSQAGK

SEQ ID NO: 762 - protein, 18 aa, Homo sapiens
YSQAVPAVTEGPIPEVLK

SEQ ID NO: 763 - protein, 412 aa, Homo sapiens
MQPSSLLPLALCLLAAPASALVRIPLHKFTSIRRTMSEVGGSVEDLIAKGPVSKYSQAVPAVTEGPIPEVLKNYMDAQYYGEIGIGTPPQCFTVVFDTGSSNLWVPSIHCKLLDIACWIHHKYNSDKSSTYVKNGTSFDIHYGSGSLSGYLSQDTVSVPCQSASSASALGGVKVERQVFGEATKQPGITFIAAKFDGILGMAYPRISVNNVLPVFDNLMQQKLVDQNIFSFYLSRDPDAQPGGELMLGGTDSKYYKGSLSYLNVTRKAYWQVHLDQVEVASGLTLCKEGCEAIVDTGTSLMVGPVDEVRELQKAIGAVPLIQGEYMIPCEKVSTLPAITLKLGGKGYKLSPEDYTLKVSQAGKTLCLSGFMGMDIPPPSGPLWILGDVFIGRYYTVFDRDNNRVGFAEAARL

SEQ ID NO: 764 - protein, 13 aa, Homo sapiens
CANLFEALVGTLK

SEQ ID NO: 765 - protein, 16 aa, Homo sapiens
MNVDHEVNLLVEEIHR

SEQ ID NO: 766 - protein, 81 aa, Homo sapiens
MNVDHEVNLLVEEIHRLGSKNADGKLSVKFGVLFRDDKCANLFEALVGTLKAAKRRKIVTYPGELLLQGVHDDVDIILLQD

SEQ ID NO: 767 - protein, 12 aa, Homo sapiens
GTVTDFPGFDER

SEQ ID NO: 768 - protein, 8 aa, Homo sapiens
QEISAAFK

SEQ ID NO: 769 - protein, 25 aa, Homo sapiens
QVYEEEYGSSLEDDVVGDTSGYYQR

SEQ ID NO: 770 - protein, 320 aa, Homo sapiens
MAQVLRGTVTDFPGFDERADAETLRKAMKGLGTDEESILTLLTSRSNAQRQEISAAFKTLFGRDLLDDLKSELTGKFEKLIVALMKPSRLYDAYELKHALKGAGTNEKVLTEIIASRTPEELRAIKQVYEEEYGSSLEDDVVGDTSGYYQRMLVVLLQANRDPDAGIDEAQVEQDAQALFQAGELKWGTDEEKFITIFGTRSVSHLRKVFDKYMTISGFQIEETIDRETSGNLEQLLLAVVKSIRSIPAYLAETLYYAMKGAGTDDHTLIRVMVSRSEIDLFNIRKEFRKNFATSLYSMIKGDTSGDYKKALLLLCGEDD

SEQ ID NO: 771 - protein, 21 aa, Homo sapiens
GQVFDQNGNPLPNVIVEVQDR

SEQ ID NO: 772 - protein, 14 aa, Homo sapiens
DSLLQDGEFSMDLR

SEQ ID NO: 773 - protein, 11 aa, Homo sapiens
EGVHGGLINKK

SEQ ID NO: 774 - protein, 16 aa, Homo sapiens
TFVNITPAEVGVLVGK

SEQ ID NO: 775 - protein, 140 aa, Homo sapiens
MAGWNAYIDNLMADGTCQDAAIVGYKDSPSVWAAVPGKTFVNITPAEVGVLVGKDRSSFYVNGLTLGGQKCSVIRDSLLQDGEFSMDLRTKSTGGAPTFNVTVTKTDKTLVLLMGKEGVHGGLINKKCYEMASHLRRSQY

SEQ ID NO: 776 - protein, 20 aa, Homo sapiens
GPVSGTEPEPVYSMEAADYR

SEQ ID NO: 777 - protein, 16 aa, Homo sapiens
TQTPPVSPAPQPTEER

SEQ ID NO: 778 - protein, 16 aa, Homo sapiens
CLDWWQEGPMYQIYPR

SEQ ID NO: 779 - protein, 22 aa, Homo sapiens
EVDPIFGTMEDFENLVAAIHDK

SEQ ID NO: 780 - protein, 13 aa, Homo sapiens
FMGTEAYAESIDR

SEQ ID NO: 781 - protein, 13 aa, Homo sapiens
LIIDFIPNHTSDK

SEQ ID NO: 782 - protein, 17 aa, Homo sapiens
LYQDLSLLHANELLLNR

SEQ ID NO: 783 - protein, 29 aa, Homo sapiens
TQIPDTVTQYSELYHDFTTTQVGMHDIVR

SEQ ID NO: 784 - protein, 13 aa, Homo sapiens
WPNWMIGGPDSSR

SEQ ID NO: 785 - protein, 6 aa, Homo sapiens
FLLEAK

SEQ ID NO: 786 - protein, 17 aa, Homo sapiens
NVFDEAILAALEPPEPK

SEQ ID NO: 787 - protein, 11 aa, Homo sapiens
QKPITPETAEK

SEQ ID NO: 788 - protein, 15 aa, Homo sapiens
TLGLFDTAGQEDYDR

SEQ ID NO: 789 - protein, 17 aa, Homo sapiens
PYTLGLFDTAGQEDYDR

SEQ ID NO: 790 - protein, 13 aa, Homo sapiens
TPFLLVGTQIDLR

SEQ ID NO: 791 - protein, 12 aa, Homo sapiens
FEHCNFNDVTTR

SEQ ID NO: 792 - protein, 16 aa, Homo sapiens
NPVFDVTASEELPLPR

SEQ ID NO: 793 - protein, 453 aa, Homo sapiens
MGVLGRVLLWLQLCALTQAVSKLWVPNTDFDVAANWSQNRTPCAGGAVEFPADKMVSVLVQEGHAVSDMLLPLDGELVLASGAGFGVSDVGSHLDCGAGEPAVFRDSDRFSWHDPHLWRSGDEAPGLFFVDAERVPCRHDDVFFPPSASFRVGLGPGASPVRVRSISALGRTFTRDEDLAVFLASRAGRLRFHGPGALSVGPEDCADPSGCVCGNAEAQPWICAALLQPLGGRCPQAACHSALRPQGQCCDLCGAVVLLTHGPAFDLERYRARILDTFLGLPQYHGLQVAVSKVPRSSRLREADTEIQVVLVENGPETGGAGRLARALLADVAENGEALGVLEATMRESGAHVWGSSAAGLAGGVAAAVLLALLVLLVAPPLLRRAGRLRWRRHEAAAPAGAPLGFRNPVFDVTASEELPLPRRLSLVPKAAADSTSHSYFVNPLFAGAEAEA

SEQ ID NO: 794 - protein, 18 aa, Homo sapiens
EFVGQLVAPLPLGTGALR

SEQ ID NO: 795 - protein, 445 aa, Homo sapiens
MLPWTALGLALSLRLALARSGAERGPPASAPRGDLMFLLDSSASVSHYEFSRVREFVGQLVAPLPLGTGALRASLVHVGSRPYTEFPFGQHSSGEAAQDAVRASAQRMGDTHTGLALVYAKEQLFAEASGARPGVPKVLVWVTDGGSSDPVGPPMQELKDLGVTVFIVSTGRGNFLELSAAASAPAEKHLHFVDVDDLHIIVQELRGSILDAMRPQQLHATEITSSGFRLAWPPLLTADSGYYVLELVPSAQPGAARRQQLPGNATDWIWAGLDPDTDYDVALVPESNVRLLRPQILRVRTRPGEAGPGASGPESGAGPAPTQLAALPAPEEAGPERIVISHARPRSLRVSWAPALGSAAALGYHVQFGPLRGGEAQRVEVPAGRNCTTLQGLAPGTAYLVTVTAAFRSGRESALSAKACTPDGPRPRPRPVPRAPTPGTASREP

SEQ ID NO: 796 - protein, 15 aa, Homo sapiens
QMLFDLESAYNAFNR

SEQ ID NO: 797 - protein, 25 aa, Homo sapiens
QTVSQWLQTLSGMSASDELDDSQVR

SEQ ID NO: 798 - protein, 15 aa, Homo sapiens
QVQGSEISSIDEFCR

SEQ ID NO: 799 - protein, 221 aa, Homo sapiens
MFHGIPATPGIGAPGNKPELYEEVKLYKNAREREKYDNMAELFAVVKTMQALEKAYIKDCVSPSEYTAACSRLLVQYKAAFRQVQGSEISSIDEFCRKFRLDCPLAMERIKEDRPITIKDDKGNLNRCIADVVSLFITVMDKLRLEIRAMDEIQPDLRELMETMHRMSHLPPDFEGRQTVSQWLQTLSGMSASDELDDSQVRQMLFDLESAYNAFNRFLHA

SEQ ID NO: 800 - protein, 15 aa, Homo sapiens
ELVDYFLNVATAQGR

SEQ ID NO: 801 - protein, 11 aa, Homo sapiens
FQVIVYNPLGR

SEQ ID NO: 802 - protein, 16 aa, Homo sapiens
HLVLLDTAQAAAAGHR

SEQ ID NO: 803 - protein, 1011 aa, Homo sapiens
MGAYARASGVCARGCLDSAGPWTMSRALRPPLPPLCFFLLLLAAAGARAGGYETCPTVQPNMLNVHLLPHTHDDVGWLKTVDQYFYGIKNDIQHAGVQYILDSVISALLADPTRRFIYVEIAFFSRWWHQQTNATQEVVRDLVRQGRLEFANGGWVMNDEAATHYGAIVDQMTLGLRFLEDTFGNDGRPRVAWHIDPFGHSREQASLFAQMGFDGFFFGRLDYQDKWVRMQKLEMEQVWRASTSLKPPTADLFTGVLPNGYNPPRNLCWDVLCVDQPLVEDPRSPEYNAKELVDYFLNVATAQGRYYRTNHTVMTMGSDFQYENANMWFKNLDKLIRLVNAQQAKGSSVHVLYSTPACYLWELNKANLTWSVKHDDFFPYADGPHQFWTGYFSSRPALKRYERLSYNFLQVCNQLEALVGLAANVGPYGSGDSAPLNEAMAVLQHHDAVSGTSRQHVANDYARQLAAGWGPCEVLLSNALARLRGFKDHFTFCQQLNISICPLSQTAARFQVIVYNPLGRKVNWMVRLPVSEGVFVVKDPNGRTVPSDVVIFPSSDSQAHPPELLFSASLPALGFSTYSVAQVPRWKPQARAPQPIPRRSWSPALTIENEHIRATFDPDTGLLMEIMNMNQQLLLPVRQTFFWYNASIGDNESDQASGAYIFRPNQQKPLPVSRWAQIHLVKTPLVQEVHQNFSAWCSQVVRLYPGQRHLELEWSVGPIPVGDTWGKEVISRFDTPLETKGRFYTDSNGREILERRRDYRPTWKLNQTEPVAGNYYPVNTRIYITDGNMQLTVLTDRSQGGSSLRDGSLELMVHRRLLKDDGRGVSEPLMENGSGAWVRGRHLVLLDTAQAAAAGHRLLAEQEVLAPQVVLAPGGGAAYNLGAPPRTQFSGLRRDLPPSVHLLTLASWGPEMVLLRLEHQFAVGEDSGRNLSAPVTLNLRDLFSTFTITRLQETTLVANQLREAASRLKWTTNTGPTPHQTPYQLDPANITLEPMEIRTFLASVQWKEVDG

SEQ ID NO: 804 - protein, 18 aa, Homo sapiens
LAALNPESNTAGLDIFAK

SEQ ID NO: 805 - protein, 9 aa, Homo sapiens
LHIVQVVCK

SEQ ID NO: 806 - protein, 22 aa, Homo sapiens
LTSPLPEEVDETSAEDEGVSQR

SEQ ID NO: 807 - protein, 27 aa, Homo sapiens
VLDNYLTSPLPEEVDETSAEDEGVSQR

SEQ ID NO: 808 - protein, 241 aa, Homo sapiens
MAEEQPQVELFVKAGSDGAKIGNCPFSQRLFMVLWLKGVTFNVTTVDTKRRTETVQKLCPGGQLPFLLYGTEVHTDTNKIEEFLEAVLCPPRYPKLAALNPESNTAGLDIFAKFSAYIKNSNPALNDNLEKGLLKALKVLDNYLTSPLPEEVDETSAEDEGVSQRKFLDGNELTLADCNLLPKLHIVQVVCKKYRGFTIPEAFRGVHRYLSNAYAREEFASTCPDDEEIELAYEQVAKALK

SEQ ID NO: 809 - protein, 24 aa, Homo sapiens
AVPHPDSQPDTIDHDLLLLQLSEK

SEQ ID NO: 810 - protein, 15 aa, Homo sapiens
RPDSLQHVLLPVLDR

SEQ ID NO: 811 - protein, 22 aa, Homo sapiens
GDSGGPLVCGGVLEGVVTSGSR

SEQ ID NO: 812 - protein, 253 aa, Homo sapiens
MHSWERLAVLVLLGAAACAAPPRGRILGGREAEAHARPYMASVQLNGAHLCGGVLVAEQWVLSAAHCLEDAADGKVQVLLGAHSLSQPEPSKRLYDVLRAVPHPDSQPDTIDHDLLLLQLSEKATLGPAVRPLPWQRVDRDVAPGTLCDVAGWGIVNHAGRRPDSLQHVLLPVLDRATCNRRTHHDGAITERLMCAESNRRDSCKGDSGGPLVCGGVLEGVVTSGSRVCGNRKKPGIYTRVASYAAWIDSVLA

SEQ ID NO: 813 - protein, 13 aa, Homo sapiens
DEVLYVFPSDFCR

SEQ ID NO: 814 - protein, 8 aa, Homo sapiens
EIIEAMLK

SEQ ID NO: 815 - protein, 30 aa, Homo sapiens
FVSAIEGMHPNQEDHETFVDINPLTGIILK

SEQ ID NO: 816 - protein, 16 aa, Homo sapiens
ITFSDYESVQGLPAFR

SEQ ID NO: 817 - protein, 7 aa, Homo sapiens
IVEWNGK

SEQ ID NO: 818 - protein, 12 aa, Homo sapiens
KLDDFVETGDIR

SEQ ID NO: 819 - protein, 11 aa, Homo sapiens
LDDFVETGDIR

SEQ ID NO: 820 - protein, 13 aa, Homo sapiens
SDYESVQGLPAFR

SEQ ID NO: 821 - protein, 19 aa, Homo sapiens
SVYITFSDYESVQGLPAFR

SEQ ID NO: 822 - protein, 19 aa, Homo sapiens
TLNIPVLTVIEWSQVHFLR

SEQ ID NO: 823 - protein, 10 aa, Homo sapiens
TSLDWWITDK

SEQ ID NO: 824 - protein, 478 aa, Homo sapiens
MGRCCFYTAGTLSLLLLVTSVTLLVARVFQKAVDQSIEKKIVLRNGTEAFDSWEKPPLPVYTQFYFFNVTNPEEILRGETPRVEEVGPYTYRELRNKANIQFGDNGTTISAVSNKAYVFERDQSVGDPKIDLIRTLNIPVLTVIEWSQVHFLREIIEAMLKAYQQKLFVTHTVDELLWGYKDEILSLIHVFRPDISPYFGLFYEKNGTNDGDYVFLTGEDSYLNFTKIVEWNGKTSLDWWITDKCNMINGTDGDSFHPLITKDEVLYVFPSDFCRSVYITFSDYESVQGLPAFRYKVPAEILANTSDNAGFCIPEGNCLGSGVLNVSICKNGAPIIMSFPHFYQADERFVSAIEGMHPNQEDHETFVDINPLTGIILKAAKRFQINIYVKKLDDFVETGDIRTMVFPVMYLNESVHIDKETASRLKSMINTTLIITNIPYIIMALGVFFGLVFTWLACKGQGSMDEGTADERAPLIRT

SEQ ID NO: 825 - protein, 22 aa, Homo sapiens
VILGAHQEVNLEPHVQEIEVSR

SEQ ID NO: 826 - protein, 810 aa, Homo sapiens
MEHKEVVLLLLLFLKSGQGEPLDDYVNTQGASLFSVTKKQLGAGSIEECAAKCEEDEEFTCRAFQYHSKEQQCVIMAENRKSSIIIRMRDVVLFEKKVYLSECKTGNGKNYRGTMSKTKNGITCQKWSSTSPHRPRFSPATHPSEGLEENYCRNPDNDPQGPWCYTTDPEKRYDYCDILECEEECMHCSGENYDGKISKTMSGLECQAWDSQSPHAHGYIPSKFPNKNLKKNYCRNPDRELRPWCFTTDPNKRWELCDIPRCTTPPPSSGPTYQCLKGTGENYRGNVAVTVSGHTCQHWSAQTPHTHNRTPENFPCKNLDENYCRNPDGKRAPWCHTTNSQVRWEYCKIPSCDSSPVSTEQLAPTAPPELTPVVQDCYHGDGQSYRGTSSTTTTGKKCQSWSSMTPHRHQKTPENYPNAGLTMNYCRNPDADKGPWCFTTDPSVRWEYCNLKKCSGTEASVVAPPPVVLLPDVETPSEEDCMFGNGKGYRGKRATTVTGTPCQDWAAQEPHRHSIFTPETNPRAGLEKNYCRNPDGDVGGPWCYTTNPRKLYDYCDVPQCAAPSFDCGKPQVEPKKCPGRVVGGCVAHPHSWPWQVSLRTRFGMHFCGGTLISPEWVLTAAHCLEKSPRPSSYKVILGAHQEVNLEPHVQEIEVSRLFLEPTRKDIALLKLSSPAVITDKVIPACLPSPNYVVADRTECFITGWGETQGTFGAGLLKEAQLPVIENKVCNRYEFLNGRVQSTELCAGHLAGGTDSCQGDSGGPLVCFEKDKYILQGVTSWGLGCARPNKPGVYVRVSRFVTWIEGVMRNN

SEQ ID NO: 827 - protein, 21 aa, Homo sapiens
AGPPGPNGAPGEPQPCLTGPR

SEQ ID NO: 828 - protein, 313 aa, Homo sapiens
MELDRAVGVLGAATLLLSFLGMAWALQAADTCPEVKMVGLEGSDKLTILRGCPGLPGAPGPKGEAGTNGKRGERGPPGPPGKAGPPGPNGAPGEPQPCLTGPRTCKDLLDRGHFLSGWHTIYLPDCRPLTVLCDMDTDGGGWTVFQRRVDGSVDFYRDWATYKQGFGSRLGEFWLGNDNIHALTAQGTSELRVDLVDFEDNYQFAKYRSFKVADEAEKYNLVLGAFVEGSAGDSLTFHNNQSFSTKDQDNDLNTGNCAVMFQGAWWYKNCHVSNLNGRYLRGTHGSFANGINWKSGKGYNYSYKVSEMKVRPA

SEQ ID NO: 829 - protein, 26 aa, Homo sapiens
GTEFAESADAALQGDPALQDAGDSSR

SEQ ID NO: 830 - protein, 9 aa, Homo sapiens
AMLVFAEHR

SEQ ID NO: 831 - protein, 16 aa, Homo sapiens
DITDTLVAVTISEGAH

SEQ ID NO: 832 - protein, 18 aa, Homo sapiens
DITDTLVAVTISEGAHHL

SEQ ID NO: 833 - protein, 21 aa, Homo sapiens
DITDTLVAVTISEGAHHLDLR

SEQ ID NO: 834 - protein, 16 aa, Homo sapiens
FLTSEQALADFAELIK

SEQ ID NO: 835 - protein, 19 aa, Homo sapiens
HLNFLTSEQALADFAELIK

SEQ ID NO: 836 - protein, 10 aa, Homo sapiens
VDHFGFNTVK

SEQ ID NO: 837 - protein, 14 aa, Homo sapiens
YYGESLPFGDNSFK

SEQ ID NO: 838 - protein, 12 aa, Homo sapiens
NALDPMSVLLAR

SEQ ID NO: 839 - protein, 18 aa, Homo sapiens
DAEEAISQTIDTIVDMIK

SEQ ID NO: 840 - protein, 1028 aa, Homo sapiens
MRAARALLPLLLQACWTAAQDEPETPRAVAFQDCPVDLFFVLDTSESVALRLKPYGALVDKVKSFTKRFIDNLRDRYYRCDRNLVWNAGALHYSDEVEIIQGLTRMPGGRDALKSSVDAVKYFGKGTYTDCAIKKGLEQLLVGGSHLKENKYLIVVTDGHPLEGYKEPCGGLEDAVNEAKHLGVKVFSVAITPDHLEPRLSIIATDHTYRRNFTAADWGQSRDAEEAISQTIDTIVDMIKNNVEQVCCSFECQPARGPPGLRGDPGFEGERGKPGLPGEKGEAGDPGRPGDLGPVGYQGMKGEKGSRGEKGSRGPKGYKGEKGKRGIDGVDGVKGEMGYPGLPGCKGSPGFDGIQGPPGPKGDPGAFGLKGEKGEPGADGEAGRPGSSGPSGDEGQPGEPGPPGEKGEAGDEGNPGPDGAPGERGGPGERGPRGTPGTRGPRGDPGEAGPQGDQGREGPVGVPGDPGEAGPIGPKGYRGDEGPPGSEGARGAPGPAGPPGDPGLMGERGEDGPAGNGTEGFPGFPGYPGNRGAPGINGTKGYPGLKGDEGEAGDPGDDNNDIAPRGVKGAKGYRGPEGPQGPPGHQGPPGPDECEILDIIMKMCSCCECKCGPIDLLFVLDSSESIGLQNFEIAKDFVVKVIDRLSRDELVKFEPGQSYAGVVQYSHSQMQEHVSLRSPSIRNVQELKEAIKSLQWMAGGTFTGEALQYTRDQLLPPSPNNRIALVITDGRSDTQRDTTPLNVLCSPGIQVVSVGIKDVFDFIPGSDQLNVISCQGLAPSQGRPGLSLVKENYAELLEDAFLKNVTAQICIDKKCPDYTCPITFSSPADITILLDGSASVGSHNFDTTKRFAKRLAERFLTAGRTDPAHDVRVAVVQYSGTGQQRPERASLQFLQNYTALASAVDAMDFINDATDVNDALGYVTRFYREASSGAAKKRLLLFSDGNSQGATPAAIEKAVQEAQRAGIEIFVVVVGRQVNEPHIRVLVTGKTAEYDVAYGESHLFRVPSYQALLRGVFHQTVSRKVALG

SEQ ID NO: 841 - protein, 16 aa, Homo sapiens
VFDKDGNGYISAAELR

SEQ ID NO: 842 - protein, 16 aa, Homo sapiens
GLGTDEDTLIEILASR

SEQ ID NO: 843 - protein, 11 aa, Homo sapiens
TPAQFDADELR

SEQ ID NO: 844 - protein, 346 aa, Homo sapiens
MAMVSEFLKQAWFIENEEQEYVQTVKSSKGGPGSAVSPYPTFNPSSDVAALHKAIMVKGVDEATIIDILTKRNNAQRQQIKAAYLQETGKPLDETLKKALTGHLEEVVLALLKTPAQFDADELRAAMKGLGTDEDTLIEILASRTNKEIRDINRVYREELKRDLAKDITSDTSGDFRNALLSLAKGDRSEDFGVNEDLADSDARALYEAGERRKGTDVNVFNTILTTRSYPQLRRVFQKYTKYSKHDMNKVLDLELKGDIEKCLTAIVKCATSKPAFFAEKLHQAMKGVGTRHKALIRIMVSRSEIDMNDIKAFYQKMYGISLCQAILDETKGDYEKILVALCGGN

SEQ ID NO: 845 - protein, 17 aa, Homo sapiens
TVNLNLWDTAGQEEYDR

SEQ ID NO: 846 - protein, 191 aa, Homo sapiens
MQSIKCVVVGDGAVGKTCLLICYTTNAFPKEYIPTVFDNYSAQSAVDGRTVNLNLWDTAGQEEYDRLRTLSYPQTNVFVICFSIASPPSYENVRHKWHPEVCHHCPDVPILLVGTKKDLRAQPDTLRRLKEQGQAPITPQQGQALAKQIHAVRYLECSALQQDGVKEVFAEAVRAVLNPTPIKRGRSCILL

SEQ ID NO: 847 - protein, 16 aa, Homo sapiens
VLPDVLQVSAAPPGPR

SEQ ID NO: 848 - protein, 11 aa, Homo sapiens
EVLVPEGPLYR

SEQ ID NO: 849 - protein, 613 aa, Homo sapiens
MGALRPTLLPPSLPLLLLLMLGMGCWAREVLVPEGPLYRVAGTAVSISCNVTGYEGPAQQNFEWFLYRPEAPDTALGIVSTKDTQFSYAVFKSRVVAGEVQVQRLQGDAVVLKIARLQAQDAGIYECHTPSTDTRYLGSYSGKVELRVLPDVLQVSAAPPGPRGRQAPTSPPRMTVHEGQELALGCLARTSTQKHTHLAVSFGRSVPEAPVGRSTLQEVVGIRSDLAVEAGAPYAERLAAGELRLGKEGTDRYRMVVGGAQAGDAGTYHCTAAEWIQDPDGSWAQIAEKRAVLAHVDVQTLSSQLAVTVGPGERRIGPGEPLELLCNVSGALPPAGRHAAYSVGWEMAPAGAPGPGRLVAQLDTEGVGSLGPGYEGRHIAMEKVASRTYRLRLEAARPGDAGTYRCLAKAYVRGSGTRLREAASARSRPLPVHVREEGVVLEAVAWLAGGTVYRGETASLLCNISVRGGPPGLRLAASWWVERPEDGELSSVPAQLVGGVGQDGVAELGVRPGGGPVSVELVGPRSHRLRLHSLGPEDEGVYHCAPSAWVQHADYSWYQAGSARSGPVTVYPYMHALDTLFVPLLVGTGVALVTGATVLGTITCCFMKRLRKR

SEQ ID NO: 850 - protein, 16 aa, Homo sapiens
VNGVLTALPVSVADGR

SEQ ID NO: 851 - protein, 16 aa, Homo sapiens
YYPLGEVFYPGPECER

SEQ ID NO: 852 - protein, 13 aa, Homo sapiens
APGWDPLCWDECR

SEQ ID NO: 853 - protein, 5405 aa, Homo sapiens
MGALWSWWILWAGATLLWGLTQEASVDLKNTGREEFLTAFLQNYQLAYSKAYPRLLISSLSESPASVSILSQADNTSKKVTVRPGESVMVNISAKAEMIGSKIFQHAVVIHSDYAISVQALNAKPDTAELTLLRPIQALGTEYFVLTPPGTSARNVKEFAVVAGAAGASVSVTLKGSVTFNGKFYPAGDVLRVTLQPYNVAQLQSSVDLSGSKVTASSPVAVLSGHSCAQKHTTCNHVVEQLLPTSAWGTHYVVPTLASQSRYDLAFVVASQATKLTYNHGGITGSRGLQAGDVVEFEVRPSWPLYLSANVGIQVLLFGTGAIRNEVTYDPYLVLIPDVAAYCPAYVVKSVPGCEGVALVVAQTKAISGLTIDGHAVGAKLTWEAVPGSEFSYAEVELGTADMIHTAEATTNLGLLTFGLAKAIGYATAADCGRTVLSPVEPSCEGMQCAAGQRCQVVGGKAGCVAESTAVCRAQGDPHYTTFDGRRYDMMGTCSYTMVELCSEDDTLPAFSVEAKNEHRGSRRVSYVGLVTVRAYSHSVSLTRGEVGFVLVDNQRSRLPVSLSEGRLRVYQSGPRAVVELVFGLVVTYDWDCQLALSLPARFQDQVCGLCGNYNGDPADDFLTPDGALAPDAVEFASSWKLDDGDYLCEDGCQNNCPACTPGQAQHYEGDRLCGMLTKLDGPFAVCHDTLDPRPFLEQCVYDLCVVGGERLSLCRGLSAYAQACLELGISVGDWRSPANCPLSCPANSRYELCGPACPTSCNGAAAPSNCSGRPCVEGCVCLPGFVASGGACVPASSCGCTFQGLQLAPGQEVWADELCQRRCTCNGATHQVTCRDKQSCPAGERCSVQNGLLGCYPDRFGTCQGSGDPHYVSFDGRRFDFMGTCTYLLVGSCGQNAALPAFRVLVENEHRGSQTVSYTRAVRVEARGVKVAVRREYPGQVLVDDVLQYLPFQAADGQVQVFRQGRDAVVRTDFGLTVTYDWNARVTAKVPSSYAEALCGLCGNFNGDPADDLALRGGGQAANALAFGNSWQEETRPGCGATEPGDCPKLDSLVAQQLQSKNECGILADPKGPFRECHSKLDPQGAVRDCVYDRCLLPGQSGPLCDALATYAAACQAAGATVHPWRSEELCPLSCPPHSHYEACSYGCPLSCGDLPVPGGCGSECHEGCVCDEGFALSGESCLPLASCGCVHQGTYHPPGQTFYPGPGCDSLCHCQEGGLVSCESSSCGPHEACQPSGGSLGCVAVGSSTCQASGDPHYTTFDGRRFDFMGTCVYVLAQTCGTRPGLHRFAVLQENVAWGNGRVSVTRVITVQVANFTLRLEQRQWKVTVNGVDMKLPVVLANGQIRASQHGSDVVIETDFGLRVAYDLVYYVRVTVPGNYYQQMCGLCGNYNGDPKDDFQKPNGSQAGNANEFGNSWEEVVPDSPCLPPTPCPPGSEDCIPSHKCPPELEKKYQKEEFCGLLSSPTGPLSSCHKLVDPQGPLKDCIFDLCLGGGNLSILCSNIHAYVSACQAAGGHVEPWRTETFCPMECPPNSHYELCADTCSLGCSALSAPPQCQDGCAEGCQCDSGFLYNGQACVPIQQCGCYHNGVYYEPEQTVLIDNCRQQCTCHAGKGMVCQEHSCKPGQVCQPSGGILSCVTKDPCHGVTCRPQETCKEQGGQGVCLPNYEATCWLWGDPHYHSFDGRKFDFQGTCNYVLATTGCPGVSTQGLTPFTVTTKNQNRGNPAVSYVRVVTVAALGTNISIHKDEIGKVRVNGVLTALPVSVADGRISVTQGASKALLVADFGLQVSYDWNWRVDVTLPSSYHGAVCGLCGNMDRNPNNDQVFPNGTLAPSIPIWGGSWRAPGWDPLCWDECRGSCPTCPEDRLEQYEGPGFCGPLAPGTGGPFTTCHAHVPPESFFKGCVLDVCMGGGDRDILCKALASYVAACQAAGVVIEDWRAQVGCEITCPENSHYEVCGSPCPASCPSPAPLTTPAVCEGPCVEGCQCDAGFVLSADRCVPLNNGCGCWANGTYHEAGSEFWADGTCSQWCRCGPGGGSLVCTPASCGLGEVCGLLPSGQHGCQPVSTAECQAWGDPHYVTLDGHRFNFQGTCEYLLSAPCHGPPLGAENFTVTVANEHRGSQAVSYTRSVTLQIYNHSLTLSARWPRKLQVDGVFVTLPFQLDSLLHAHLSGADVVVTTTSGLSLAFDGDSFVRLRVPAAYAGSLCGLCGNYNQDPADDLKAVGGKPAGWQVGGAQGCGECVSKPCPSPCTPEQQESFGGPDACGVISATDGPLAPCHGLVPPAQYFQGCLLDACQVQGHPGGLCPAVATYVAACQAAGAQLREWRRPDFCPFQCPAHSHYELCGDSCPGSCPSLSAPEGCESACREGCVCDAGFVLSGDTCVPVGQCGCLHDDRYYPLGQTFYPGPGCDSLCRCREGGEVSCEPSSCGPHETCRPSGGSLGCVAVGSTTCQASGDPHYTTFDGRRFDFMGTCVYVLAQTCGTRPGLHRFAVLQENVAWGNGRVSVTRVITVQVANFTLRLEQRQWKVTVNGVDMKLPVVLANGQIRASQHGSDVVIETDFGLRVAYDLVYYVRVTVPGNYYQLMCGLCGNYNGDPKDDFQKPNGSQAGNANEFGNSWEEVVPDSPCLPPPTCPPGSEGCIPSEECPPELEKKYQKEEFCGLLSSPTGPLSSCHKLVDPQGPLKDCIFDLCLGGGNLSILCSNIHAYVSACQAAGGQVEPWRNETFCPMECPQNSHYELCADTCSLGCSALSAPLQCPDGCAEGCQCDSGFLYNGQACVPIQQCGCYHNGAYYEPEQTVLIDNCRQQCTCHVGKVVVCQEHSCKPGQVCQPSGGILSCVNKDPCHGVTCRPQETCKEQGGQGVCLPNYEATCWLWGDPHYHSFDGRKFDFQGTCNYVLATTGCPGVSTQGLTPFTVTTKNQNRGNPAVSYVRVVTVAALGTNISIHKDEIGKVRVNGVLTALPVSVADGRISVTQGASKALLVADFGLQVSYDWNWRVDVTLPSSYHGAVCGLCGNMDRNPNNDQVFPNGTLAPSIPIWGGSWRAPGWDPLCWDECRGSCPTCPEDRLEQYEGPGFCGPLAPGTGGPFTTCHAHVPPESFFKGCVLDVCMGGGDRDILCKALASYVAACQAAGVVIEDWRAQVGCEITCPENSHYEVCGPPCPASCPSPAPLTTPAVCEGPCVEGCQCDAGFVLSADRCVPLNNGCGCWANGTYHEAGSEFWADGTCSQWCRCGPGGGSLVCTPASCGLGEVCGLLPSGQHGCQPVSTAECQAWGDPHYVTLDGHRFDFQGTCEYLLSAPCHGPPLGAENFTVTVANEHRGSQAVSYTRSVTLQIYNHSLTLSARWPRKLQVDGVFVTLPFQLDSLLHAHLSGADVVVTTTSGLSLAFDGDSFVRLRVPAAYAGSLCGLCGNYNQDPADDLKAVGGKPAGWQVGGAQGCGECVSKPCPSPCTPEQQESFGGPDACGVISATDGPLAPCHGLVPPAQYFQGCLLDACQVQGHPGGLCPAVATYVAACQAAGAQLREWRRPDFCPFQCPAHSHYELCGDSCPGSCPSLSAPEGCESACREGCVCDAGFVLSGDTCVPVGQCGCLHDDRYYPLGQTFYPGPGCDSLCRCREGGEVSCEPSSCGPHETCRPSGGSLGCVAVGSTTCQASGDPHYTTFDGHRFDFMGTCVYVLAQTCGTRPGLHRFAVLQENVAWGNGRVSVTRVITVQVANFTLRLEQRQWKVTVNGVDMKLPVVLANGQIRASQHGSDVVIETDFGLRVAYDLVYYVRVTVPGNYYQLMCGLCGNYNGDPKDDFQKPNGSQAGNANEFGNSWEEVVPDSPCLPPPTCPPGSAGCIPSDKCPPELEKKYQKEEFCGLLSSPTGPLSSCHKLVDPQGPLKDCIFDLCLGGGNLSILCSNIHAYVSACQAAGGHVEPWRNETFCPMECPQNSHYELCADTCSLGCSALSAPLQCPDGCAEGCQCDSGFLYNGQACVPIQQCGCYHNGVYYEPEQTVLIDNCRQQCTCHVGKVVVCQEHSCKPGQVCQPSGGILSCVTKDPCHGVTCRPQETCKEQGGQGVCLPNYEATCWLWGDPHYHSFDGRKFDFQGTCNYVLATTGCPGVSTQGLTPFTVTTKNQNRGNPAVSYVRVVTVAALGTNISIHKDEIGKVRVNGVLTALPVSVADGRISVAQGASKALLVADFGLQVSYDWNWRVDVTLPSSYHGAVCGLCGNMDRNPNNDQVFPNGTLAPSIPIWGGSWRAPGWDPLCWDECRGSCPTCPEDRLEQYEGPGFCGPLSSGTGGPFTTCHAHVPPESFFKGCVLDVCMGGGDRDILCKALASYVAACQAAGVVIEDWRAQVGCEITCPENSHYEVCGPPCPASCPSPAPLTTPAVCEGPCVEGCQCDAGFVLSADRCVPLNNGCGCWANGTYHEAGSEFWADGTCSQWCRCGPGGGSLVCTPASCGLGEVCGLLPSGQHGCQPVSTAECQAWGDPHYVTLDGHRFDFQGTCEYLLSAPCHGPPLGAENFTVTVANEHRGSQAVSYTRSVTLQIYNHSLTLSARWPRKLQVDGVFVALPFQLDSLLHAHLSGADVVVTTTSGLSLAFDGDSFVRLRVPAAYAASLCGLCGNYNQDPADDLKAVGGKPAGWQVGGAQGCGECVSKPCPSPCTPEQQESFGGPDACGVISATDGPLAPCHGLVPPAQYFQGCLLDACQVQGHPGGLCPAVATYVAACQAAGAQLGEWRRPDFCPLQCPAHSHYELCGDSCPVSCPSLSAPEGCESACREGCVCDAGFVLSGDTCVPVGQCGCLHDGRYYPLGEVFYPGPECERRCECGPGGHVTCQEGAACGPHEECRLEDGVQACHATGCGRCLANGGIHYITLDGRVYDLHGSCSYVLAQVCHPKPGDEDFSIVLEKNAAGDLQRLLVTVAGQVVSLAQGQQVTVDGEAVALPVAVGRVRVTAEGRNMVLQTTKGLRLLFDGDAHLLMSIPSPFRGRLCGLCGNFNGNWSDDFVLPNGSAASSVETFGAAWRAPGSSKGCGEGCGPQGCPVCLAEETAPYESNEACGQLRNPQGPFATCQAVLSPSEYFRQCVYDLCAQKGDKAFLCRSLAAYTAACQAAGVAVKPWRTDSFCPLHCPAHSHYSICTRTCQGSCAALSGLTGCTTRCFEGCECDDRFLLSQGVCIPVQDCGCTHNGRYLPVNSSLLTSDCSERCSCSSSSGLTCQAAGCPPGRVCEVKAEARNCWATRGLCVLSVGANLTTFDGARGATTSPGVYELSSRCPGLQNTIPWYRVVAEVQICHGKTEAVGQVHIFFQDGMVTLTPNKGVWVNGLRVDLPAEKLASVSVSRTPDGSLLVRQKAGVQVWLGANGKVAVIVSNDHAGKLCGACGNFDGDQTNDWHDSQEKPAMEKWRAQDFSPCYG

SEQ ID NO: 854 - protein, 20 aa, Homo sapiens
EGESNLGLDLEEKEPGDHER

SEQ ID NO: 855 - protein, 14 aa, Homo sapiens
MESNLYQDQSEDKR

SEQ ID NO: 856 - protein, 14 aa, Homo sapiens
SFPAAAVLPTGAAR

SEQ ID NO: 857 - protein, 251 aa, Homo sapiens
MYRARAARAGPEPGSPGRFGILSTGQLRDLLQDEPKLDRIVRLSRKFQGLQLEREACLASNYALAKENLALRPRLEMGRAALAIKYQELREVAENCADKLQRLEESMHRWSPHCALGWLQAELEEAEQEAEEQMEQLLLGEQSLEAFLPAFQRGRALAHLRRTQAEKLQELLRRRERSAQPAPTSAADPPKSFPAAAVLPTGAARGPPAVPRSLPPLDSRPVPPLKGSPGCPLGPAPLLSPRPSQPEPPHR

SEQ ID NO: 858 - protein, 8 aa, Homo sapiens
NKPGVYTK

SEQ ID NO: 859 - protein, 247 aa, Homo sapiens
MNPLLILTFVAAALAAPFDDDDKIVGGYNCEENSVPYQVSLNSGYHFCGGSLINEQWVVSAGHCYKSRIQVRLGEHNIEVLEGNEQFINAAKIIRHPQYDRKTLNNDIMLIKLSSRAVINARVSTISLPTAPPATGTKCLISGWGNTASSGADYPDELQCLDAPVLSQAKCEASYPGKITSNMFCVGFLEGGKDSCQGDSGGPVVCNGQLQGVVSWGDGCAQKNKPGVYTKVYNYVKWIKNTIAANS

SEQ ID NO: 860 - protein, 25 aa, Homo sapiens
TSMEQLAQELQGLAQAQDNSVLGQR

SEQ ID NO: 861 - protein, 834 aa, Homo sapiens
MKHTLALLAPLLGLGLGLALSQLAAGATDCKFLGPAEHLTFTPAARARWLAPRVRAPGLLDSLYGTVRRFLSVVQLNPFPSELVKALLNELASVKVNEVVRYEAGYVVCAVIAGLYLLLVPTAGLCFCCCRCHRRCGGRVKTEHKALACERAALMVFLLLTTLLLLIGVVCAFVTNQRTHEQMGPSIEAMPETLLSLWGLVSDVPQELQAVAQQFSLPQEQVSEELDGVGVSIGSAIHTQLRSSVYPLLAAVGSLGQVLQVSVHHLQTLNATVVELQAGQQDLEPAIREHRDRLLELLQEARCQGDCAGALSWARTLELGADFSQVPSVDHVLHQLKGVPEANFSSMVQEENSTFNALPALAAMQTSSVVQELKKAVAQQPEGVRTLAEGFPGLEAASRWAQALQEVEESSRPYLQEVQRYETYRWIVGCVLCSVVLFVVLCNLLGLNLGIWGLSARDDPSHPEAKGEAGARFLMAGVGLSFLFAAPLILLVFATFLVGGNVQTLVCRSWENGELFEFADTPGNLPPSMNLSQLLGLRKNISIHQAYQQCKEGAALWTVLQLNDSYDLEEHLDINQYTNKLRQELQSLKVDTQSLDLLSSAARRDLEALQSSGLQRIHYPDFLVQIQRPVVKTSMEQLAQELQGLAQAQDNSVLGQRLQEEAQGLRNLHQEKVVPQQSLVAKLNLSVRALESSAPNLQLETSDVLANVTYLKGELPAWAARILRNVSECFLAREMGYFSQYVAWVREEVTQRIATCQPLSGALDNSRVILCDMMADPWNAFWFCLAWCTFFLIPSIIFAVKTSKYFRPIRKRLSSTSSEETQLFHIPRVTSLKL

SEQ ID NO: 862 - protein, 17 aa, Homo sapiens
GQDHCGIESEVVAGIPR

SEQ ID NO: 863 - protein, 17 aa, Homo sapiens
FFPEDVSEELIQEITQR

SEQ ID NO: 864 - protein, 583 aa, Homo sapiens
MPKPINVRVTTMDAELEFAIQPNTTGKQLFDQVVKTVGLREVWFFGLQYVDSKGYSTWLKLNKKVTQQDVKKENPLQFKFRAKFFPEDVSEELIQEITQRLFFLQVKEAILNDEIYCPPETAVLLASYAVQAKYGDYNKEIHKPGYLANDRLLPQRVLEQHKLTKEQWEERIQNWHEEHRGMLREDSMMEYLKIAQDLEMYGVNYFEIKNKKGTELWLGVDALGLNIYEHDDKLTPKIGFPWSEIRNISFNDKKFVIKPIDKKAPDFVFYAPRLRINKRILALCMGNHELYMRRRKPDTIEVQQMKAQAREEKHQKQLERAQLENEKKKREIAEKEKERIEREKEELMERLKQIEEQTIKAQKELEEQTRKALELDQERKRAKEEAERLEKERRAAEEAKSAIAKQAADQMKNQEQLAAELAEFTAKIALLEEAKKKKEEEATEWQHKAFAAQEDLEKTKEELKTVMSAPPPPPPPPVIPPTENEHDEHDENNAEASAELSNEGVMNHRSEEERVTETQKNERVKKQLQALSSELAQARDETKKTQNDVLHAENVKAGRDKYKTLRQIRQGNTKQRIDEFEAM

SEQ ID NO: 865 - protein, 10 aa, Homo sapiens
EAILDIITSR

SEQ ID NO: 866 - protein, 16 aa, Homo sapiens
GLGTDEDTIIDIITHR

SEQ ID NO: 867 - protein, 19 aa, Homo sapiens
GSIHDFPGFDPNQDAEALY

SEQ ID NO: 868 - protein, 11 aa, Homo sapiens
ALDFAVGEYNK

SEQ ID NO: 869 - protein, 17 aa, Homo sapiens
KQIVAGVNYFLDVELGR

SEQ ID NO: 870 - protein, 13 aa, Homo sapiens
LDNCPFHDQPHLK

SEQ ID NO: 871 - protein, 16 aa, Homo sapiens
LVGGPMDASVEEEGVR

SEQ ID NO: 872 - protein, 17 aa, Homo sapiens
LVGGPMDASVEEEGVRR

SEQ ID NO: 873 - protein, 16 aa, Homo sapiens
QIVAGVNYFLDVELGR

SEQ ID NO: 874 - protein, 17 aa, Homo sapiens
TQPNLDNCPFHDQPHLK

SEQ ID NO: 875 - protein, 15 aa, Homo sapiens
VGGPMDASVEEEGVR

SEQ ID NO: 876 - protein, 8 aa, Homo sapiens
FLDVELGR

SEQ ID NO: 877 - protein, 146 aa, Homo sapiens
MAGPLRAPLLLLAILAVALAVSPAAGSSPGKPPRLVGGPMDASVEEEGVRRALDFAVGEYNKASNDMYHSRALQVVRARKQIVAGVNYFLDVELGRTTCTKTQPNLDNCPFHDQPHLKRKAFCSFQIYAVPWQGTMTLSKSTCQDA

SEQ ID NO: 878 - protein, 8 aa, Homo sapiens
AANPFQQK

SEQ ID NO: 879 - protein, 11 aa, Homo sapiens
AAPWWVSLLHR

SEQ ID NO: 880 - protein, 14 aa, Homo sapiens
ALVEMQDVVAELLR

SEQ ID NO: 881 - protein, 15 aa, Homo sapiens
GPDEDGEEEAAPGPR

SEQ ID NO: 882 - protein, 22 aa, Homo sapiens
MVEEYSVLSGDILQYYLACSPR

SEQ ID NO: 883 - protein, 10 aa, Homo sapiens
QLAGRPEPLR

SEQ ID NO: 884 - protein, 21 aa, Homo sapiens
TVSNAPVTEYMSQNANFQNPR

SEQ ID NO: 885 - protein, 15 aa, Homo sapiens
TVPWEQPATKDPLLR

SEQ ID NO: 886 - protein, 523 aa, Homo sapiens
MAGVSYAAPWWVSLLHRLPHFDLSWEATSSQFRPEDTDYQQALLLLGAAALACLALDLLFLLFYSFWLCCRRRKSEEHLDADCCCTAWCVIIATLVCSAGIAVGFYGNGETSDGIHRATYSLRHANRTVAGVQDRVWDTAVGLNHTAEPSLQTLERQLAGRPEPLRAVQRLQGLLETLLGYTAAIPFWRNTAVSLEVLAEQVDLYDWYRWLGYLGLLLLDVIICLLVLVGLIRSSKGILVGVCLLGVLALVISWGALGLELAVSVGSSDFCVDPDAYVTKMVEEYSVLSGDILQYYLACSPRAANPFQQKLSGSHKALVEMQDVVAELLRTVPWEQPATKDPLLRVQEVLNGTEVNLQHLTALVDCRSLHLDYVQALTGFCYDGVEGLIYLALFSFVTALMFSSIVCSVPHTWQQKRGPDEDGEEEAAPGPRQAHDSLYRVHMPSLYSCGSSYGSETSIPAAAHTVSNAPVTEYMSQNANFQNPRCENTPLIGRESPPPSYTSSMRAKYLATSQPRPDSSGSH

SEQ ID NO: 887 - protein, 17 aa, Homo sapiens
QGYPQYGWQGGPQEPPK

SEQ ID NO: 888 - protein, 10 aa, Homo sapiens
TTVYVVEDQR

SEQ ID NO: 889 - protein, 97 aa, Homo sapiens
MNQENPPPYPGPGPTAPYPPYPPQPMGPGPMGGPYPPPQGYPYQGYPQYGWQGGPQEPPKTTVYVVEDQRRDELGPSTCLTACWTALCCCCLWDMLT

SEQ ID NO: 890 - protein, 16 aa, Homo sapiens
EDSLQDAWDYVQAQVK

SEQ ID NO: 891 - protein, 12 aa, Homo sapiens
QEMGGIVTELIR

SEQ ID NO: 892 - protein, 19 aa, Homo sapiens
DPEEPDGGELVLGGSDPAH

SEQ ID NO: 893 - protein, 21 aa, Homo sapiens
GCAAILDTGTSLITGPTEEIR

SEQ ID NO: 894 - protein, 17 aa, Homo sapiens
ILDTGTSLITGPTEEIR

SEQ ID NO: 895 - protein, 15 aa, Homo sapiens
SPGDKPIFVPLSNYR

SEQ ID NO: 896 - protein, 16 aa, Homo sapiens
TVAFDTGSSNLWVPSR

SEQ ID NO: 897 - protein, 16 aa, Homo sapiens
VDGILSEDKLTIGGIK

SEQ ID NO: 898 - protein, 420 aa, Homo sapiens
MSPPPLLQPLLLLLPLLNVEPSGATLIRIPLHRVQPGRRILNLLRGWREPAELPKLGAPSPGDKPIFVPLSNYRDVQYFGEIGLGTPPQNFTVAFDTGSSNLWVPSRRCHFFSVPCWLHHRFDPKASSSFQANGTKFAIQYGTGRVDGILSEDKLTIGGIKGASVIFGEALWEPSLVFAFAHFDGILGLGFPILSVEGVRPPMDVLVEQGLLDKPVFSFYLNRDPEEPDGGELVLGGSDPAHYIPPLTFVPVTVPAYWQIHMERVKVGPGLTLCAKGCAAILDTGTSLITGPTEEIRALHAAIGGIPLLAGEYIILCSEIPKLPAVSFLLGGVWFNLTAHDYVIQTTRNGVRLCLSGFQALDVPPPAGPFWILGDVFLGTYVAVFDRGDMKSSARVGLARARTRGADLGWGETAQAQFPG

SEQ ID NO: 899 - protein, 14 aa, Homo sapiens
EGMLQHWELGQALR

SEQ ID NO: 900 - protein, 7 aa, Homo sapiens
FVTLLYR

SEQ ID NO: 901 - protein, 15 aa, Homo sapiens
NVYDTLFCEQTHGLR

SEQ ID NO: 902 - protein, 20 aa, Homo sapiens
TLMSAEANLAGLFPPNGMQR

SEQ ID NO: 903 - protein, 423 aa, Homo sapiens
MAGKRSGWSRAALLQLLLGVNLVVMPPTRARSLRFVTLLYRHGDRSPVKTYPKDPYQEEEWPQGFGQLTKEGMLQHWELGQALRQRYHGFLNTSYHRQEVYVRSTDFDRTLMSAEANLAGLFPPNGMQRFNPNISWQPIPVHTVPITEDRLLKFPLGPCPRYEQLQNETRQTPEYQNESSRNAQFLDMVANETGLTDLTLETVWNVYDTLFCEQTHGLRLPPWASPQTMQRLSRLKDFSFRFLFGIYQQAEKARLQGGVLLAQIRKNLTLMATTSQLPKLLVYSAHDTTLVALQMALDVYNGEQAPYASCHIFELYQEDSGNFSVEMYFRNESDKAPWPLSLPGCPHRCPLQDFLRLTEPVVPKDWQQECQLASGPADTEVIVALAVCGSILFLLIVLLLTVLFRMQAQPPGYRHVADGEDHA

SEQ ID NO: 904 - protein, 12 aa, Homo sapiens
SWFEPLVEDMQR

SEQ ID NO: 905 - protein, 23 aa, Homo sapiens
WVQTLSEQVQEELLSSQVTQELR

SEQ ID NO: 906 - protein, 317 aa, Homo sapiens [sequence omitted]

SEQ ID NO: 907 - protein, 14 aa, Homo sapiens
FLFHPGDTVPSTAR

SEQ ID NO: 908 - protein, 13 aa, Homo sapiens
LFHPGDTVPSTAR

SEQ ID NO: 909 - protein, 13 aa, Homo sapiens
LLGENSVPPSPSR

SEQ ID NO: 910 - protein, 20 aa, Homo sapiens
SEFVVPDLELPSWLTTGNYR

SEQ ID NO: 911 - protein, 193 aa, Homo sapiens
MQSLMQAPLLIALGLLLAAPAQAHLKKPSQLSSFSWDNCDEGKDPAVIRSLTLEPDPIIVPGNVTLSVMGSTSVPLSSPLKVDLVLEKEVAGLWIKIPCTDYIGSCTFEHFCDVLDMLIPTGEPCPEPLRTYGLPCHCPFKEGTYSLPKSEFVVPDLELPSWLTTGNYRIESVLSSSGKRLGCIKIAASLKGI

SEQ ID NO: 912 - protein, 13 aa, Homo sapiens
ALVSAQWVAEALR

SEQ ID NO: 913 - protein, 16 aa, Homo sapiens
HIPGAAFFDIDQCSDR

SEQ ID NO: 914 - protein, 16 aa, Homo sapiens
GLPPVDFVPPIGVESR

SEQ ID NO: 915 - protein, 15 aa, Homo sapiens
MYFDAVQAIETHLIR

SEQ ID NO: 916 - protein, 653 aa, Homo sapiens
MPVGGLLPLFSSPAGGVLGGGLGGGGGRKGSGPAALRLTEKFVLLLVFSAFITLCFGAIFFLPDSSKLLSGVLFHSSPALQPAADHKPGPGARAEDAAEGRARRREEGAPGDPEAALEDNLARIRENHERALREAKETLQKLPEEIQRDILLEKKKVAQDQLRDKAPFRGLPPVDFVPPIGVESREPADAAIREKRAKIKEMMKHAWNNYKGYAWGLNELKPISKGGHSSSLFGNIKGATIVDALDTLFIMEMKHEFEEAKSWVEENLDFNVNAEISVFEVNIRFVGGLLSAYYLSGEEIFRKKAVELGVKLLPAFHTPSGIPWALLNMKSGIGRNWPWASGGSSILAEFGTLHLEFMHLSHLSGNPIFAEKVMNIRTVLNKLEKPQGLYPNYLNPSSGQWGQHHVSVGGLGDSFYEYLLKAWLMSDKTDLEAKKMYFDAVQAIETHLIRKSSSGLTYIAEWKGGLLEHKMGHLTCFAGGMFALGADAAPEGMAQHYLELGAEIARTCHESYNRTFMKLGPEAFRFDGGVEAIATRQNEKYYILRPEVMETYMYMWRLTHDPKYRKWAWEAVEALENHCRVNGGYSGLRDVYLLHESYDDVQQSFFLAETLKYLYLIFSDDDLLPLEHWIFNSEAHLLPILPKDKKEVEIREE

SEQ ID NO: 917 - protein, 18 aa, Homo sapiens
SGEEALIIPPDAVAVDCK

SEQ ID NO: 918 - protein, 11 aa, Homo sapiens
DPDDVVPVGQR

SEQ ID NO: 919 - protein, 266 aa, Homo sapiens
MVKVTFNSALAQKEAKKDEPKSGEEALIIPPDAVAVDCKDPDDVVPVGQRRAWCWCMCFGLAFMLAGVILGGAYLYKYFALQPDDVYYCGIKYIKDDVILNEPSADAPAALYQTIEENIKIFEEEEVEFISVPVPEFADSDPANIVHDFNKKLTAYLDLNLDKCYVIPLNTSIVMPPRNLLELLINIKAGTYLPQSYLIHEHMVITDRIENIDHLGFFIYRLCHDKETYKLQRRETIKGIQKREASNCFAIRHFENKFAVETLICS

SEQ ID NO: 920 - protein, 18 aa, Homo sapiens
AHDQKVEGCFNQLLYDIR

SEQ ID NO: 921 - protein, 7 aa, Homo sapiens
QKAHDQK

SEQ ID NO: 922 - protein, 13 aa, Homo sapiens
VEGCFNQLLYDIR

SEQ ID NO: 923 - protein, 7 aa, Homo sapiens
LVVPAIK

SEQ ID NO: 924 - protein, 241 aa, Homo sapiens
MQCFSFIKTMMILFNLLIFLCGAALLAVGIWVSIDGASFLKIFGPLSSSAMQFVNVGYFLIAAGVVVFALGFLGCYGAKTESKCALVTFFFILLLIFIAEVAAAVVALVYTTMAEHFLTLLVVPAIKKDYGSQEDFTQVWNTTMKGLKCCGFTNYTDFEDSPYFKENSAFPPFCCNDNVTNTANETCTKQKAHDQKVEGCFNQLLYDIRTNAVTVGGVAAGIGGLELAAMIVSMYLYCNLQ

SEQ ID NO: 925 - protein, 14 aa, Homo sapiens
CPNPPVQENFDVNK

SEQ ID NO: 926 - protein, 9 aa, Homo sapiens
IPTTFENGR

SEQ ID NO: 927 - protein, 12 aa, Homo sapiens
KMTVTDQVNCPK

SEQ ID NO: 928 - protein, 11 aa, Homo sapiens
MTVTDQVNCPK

SEQ ID NO: 929 - protein, 11 aa, Homo sapiens
NILTSNNIDVK

SEQ ID NO: 930 - protein, 13 aa, Homo sapiens
NPNLPPETVDSLK

SEQ ID NO: 931 - protein, 12 aa, Homo sapiens
NPPVQENFDVNK

SEQ ID NO: 932 - protein, 6 aa, Homo sapiens
WYEIEK

SEQ ID NO: 933 - protein, 15 aa, Homo sapiens
WYEIEKIPTTFENGR

SEQ ID NO: 934 - protein, 189 aa, Homo sapiens
MVMLLLLLSALAGLFGAAEGQAFHLGKCPNPPVQENFDVNKYLGRWYEIEKIPTTFENGRCIQANYSLMENGKIKVLNQELRADGTVNQIEGEATPVNLTEPAKLEVKFSWFMPSAPYWILATDYENYALVYSCTCIIQLFHVDFAWILARNPNLPPETVDSLKNILTSNNIDVKKMTVTDQVNCPKLS

SEQ ID NO: 935 - protein, 16 aa, Homo sapiens
EASMVITESPAALQLR

SEQ ID NO: 936 - protein, 21 aa, Homo sapiens
EEIAHNMQSTLDDATDAWGIK

SEQ ID NO: 937 - protein, 11 aa, Homo sapiens
FILPCTDSFIK

SEQ ID NO: 938 - protein, 14 aa, Homo sapiens
TISFDIPPQEILTK

SEQ ID NO: 939 - protein, 12 aa, Homo sapiens
VIAAEGEMNASR

SEQ ID NO: 940 - protein, 19 aa, Homo sapiens
VQNATLAVANITNADSATR

SEQ ID NO: 941 - protein, 12 aa, Homo sapiens
YLQTLTTIAAEK

SEQ ID NO: 942 - protein, 7 aa, Homo sapiens
LPVQLQR

SEQ ID NO: 943 - protein, 8 aa, Homo sapiens
LLAQTTLR

SEQ ID NO: 944 - protein, 288 aa, Homo sapiens [sequence omitted]

SEQ ID NO: 945 - protein, 24 aa, Homo sapiens
TSIEDQDELSSLLQVPLVAGTVNR

SEQ ID NO: 946 - protein, 226 aa, Homo sapiens
MAVRASFENNCEIGCFAKLTNTYCLVAIGGSENFYRCGGSPGAYGGGEACAGVKSSGSGRVPAPLPRHHRVHVPTVCSRASSPIPSPWCTRLSPAAASSGACVWETEEILADVLKVEVFRQTVADQVLVGSYCVFSNQGGLVHPKTSIEDQDELSSLLQVPLVAGTVNRGSEVIAAGMVVNDWCAFCGLDTTSTELSVVESVFKLNEAQPSTIATSMRDSLIDSLT

SEQ ID NO: 947 - protein, 19 aa, Homo sapiens
DIPTNSPELEETLTHTITK

SEQ ID NO: 948 - protein, 8 aa, Homo sapiens
YFIDFVAR

SEQ ID NO: 949 - protein, 13 aa, Homo sapiens
IGEIKEETTSHLR

SEQ ID NO: 950 - protein, 427 aa, Homo sapiens
MKLITILFLCSRLLLSLTQESQSEEIDCNDKDLFKAVDAALKKYNSQNQSNNQFVLYRITEATKTVGSDTFYSFKYEIKEGDCPVQSGKTWQDCEYKDAAKAATGECTATVGKRSSTKFSVATQTCQITPAEGPVVTAQYDCLGCVHPISTQSPDLEPILRHGIQYFNNNTQHSSLFMLNEVKRAQRQVVAGLNFRITYSIVQTNCSKENFLFLTPDCKSLWNGDTGECTDNAYIDIQLRIASFSQNCDIYPGKDFVQPPTKICVGCPRDIPTNSPELEETLTHTITKLNAENNATFYFKIDNVKKARVQVVAGKKYFIDFVARETTCSKESNEELTESCETKKLGQSLDCNAEVYVVPWEKKIYPTVNCQPLGMISLMKRPPGFSPFRSSRIGEIKEETTSHLRSCEYKGRPPKAGAEPASEREVS

SEQ ID NO: 951 - protein, 17 aa, Homo sapiens
ANVAVVSGAPLQGLVAR

SEQ ID NO: 952 - protein, 21 aa, Homo sapiens
ALSCTAEEQGVLPDDLSGVIR

SEQ ID NO: 953 - protein, 15 aa, Homo sapiens
IAQSDYIPTQQDVLR

SEQ ID NO: 954 - protein, 19 aa, Homo sapiens
SCTAEEQGVLPDDLSGVIR

SEQ ID NO: 955 - protein, 355 aa, Homo sapiens
MGCTVSAEDKAAAERSKMIDKNLREDGEKAAREVKLLLLGAGESGKSTIVKQMKIIHEDGYSEEECRQYRAVVYSNTIQSIMAIVKAMGNLQIDFADPSRADDARQLFALSCTAEEQGVLPDDLSGVIRRLWADHGVQACFGRSREYQLNDSAAYYLNDLERIAQSDYIPTQQDVLRTRVKTTGIVETHFTFKDLHFKMFDVGGQRSERKKWIHCFEGVTAIIFCVALSAYDLVLAEDEEMNRMHESMKLFDSICNNKWFTDTSIILFLNKKDLFEEKITHSPLTICFPEYTGANKYDEAASYIQSKFEDLNKRKDTKEIYTHFTCATDTKNVQFVFDAVTDVIIKNNLKDCGLF

SEQ ID NO: 956 - protein, 15 aa, Homo sapiens
IAAADYIPTVEDILR

SEQ ID NO: 957 - protein, 355 aa, Homo sapiens
MGCRQSSEEKEAARRSRRIDRHLRSESQRQRREIKLLLLGTSNSGKSTIVKQMKIIHSGGFNLEACKEYKPLIIYNAIDSLTRIIRALAALRIDFHNPDRAYDAVQLFALTGPAESKGEITPELLGVMRRLWADPGAQACFSRSSEYHLEDNAAYYLNDLERIAAADYIPTVEDILRSRDMTTGIVENKFTFKELTFKMVDVGGQRSERKKWIHCFEGVTAIIFCVELSGYDLKLYEDNQTSRMAESLRLFDSICNNNWFINTSLILFLNKKDLLAEKIRRIPLTICFPEYKGQNTYEEAAVYIQRQFEDLNRNKETKEIYSHFTCATDTSNIQFVFDAVTDVIIQNNLKYIGLC

SEQ ID NO: 958 - protein, 12 aa, Homo sapiens
VWPNPEVFDPFR

SEQ ID NO: 959 - protein, 519 aa, Homo sapiens
MSVSVLSPSRLLGDVSGILQAASLLILLLLLIKAVQLYLHRQWLLKALQQFPCPPSHWLFGHIQELQQDQELQRIQKWVETFPSACPHWLWGGKVRVQLYDPDYMKVILGRSDPKSHGSYRFLAPWIGYGLLLLNGQTWFQHRRMLTPAFHYDILKPYVGLMADSVRVMLDKWEELLGQDSPLEVFQHVSLMTLDTIMKCAFSHQGSIQVDRNSQSYIQAISDLNNLVFSRVRNAFHQNDTIYSLTSAGRWTHRACQLAHQHTDQVIQLRKAQLQKEGELEKIKRKRHLDFLDILLLAKMENGSILSDKDLRAEVDTFMFEGHDTTASGISWILYALATHPKHQERCREEIHSLLGDGASITWNHLDQMPYTTMCIKEALRLYPPVPGIGRELSTPVTFPDGRSLPKGIMVLLSIYGLHHNPKVWPNPEVFDPFRFAPGSAQHSHAFLPFSGGSRNCIGKQFAMNELKVATALTLLRFELLPDPTRIPIPIARLVLKSKNGIHLRLRRLPNPCEDKDQL

SEQ ID NO: 960 - protein, 31 aa, Homo sapiens
DLGDVGPPIPSPGFSSFPGVDSSSSFSSSSR

SEQ ID NO: 961 - protein, 9 aa, Homo sapiens
DLSVLQKPQ

SEQ ID NO: 962 - protein, 16 aa, Homo sapiens
DQNTPVVHPPPTPGSC

SEQ ID NO: 963 - protein, 18 aa, Homo sapiens
DQNTPVVHPPPTPGSCGH

SEQ ID NO: 964 - protein, 14 aa, Homo sapiens
DTISYTELDFELIK

SEQ ID NO: 965 - protein, 9 aa, Homo sapiens
DYSPQHPNK

SEQ ID NO: 966 - protein, 18 aa, Homo sapiens
ESFGGSSEIVDQLEVEIR

SEQ ID NO: 967 - protein, 11 aa, Homo sapiens
EYVQLISVYEK

SEQ ID NO: 968 - protein, 11 aa, Homo sapiens
GFSYLYGAWGR

SEQ ID NO: 969 - protein, 13 aa, Homo sapiens
GLYWVAPLNTDGR

SEQ ID NO: 970 - protein, 18 aa, Homo sapiens
GTCQCSVSLPDTTFPVDR

SEQ ID NO: 971 - protein, 28 aa, Homo sapiens
ITYGQGSGTAVYNNNMYVNMYNTGNIAR

SEQ ID NO: 972 - protein, 7 aa, Homo sapiens
LDIVMHK

SEQ ID NO: 973 - protein, 8 aa, Homo sapiens
LEFTAHVL

SEQ ID NO: 974 - protein, 11 aa, Homo sapiens
LEFTAHVLSQK

SEQ ID NO: 975 - protein, 14 aa, Homo sapiens
LEFTAHVLSQKFEK

SEQ ID NO: 976 - protein, 13 aa, Homo sapiens
LETLDKNNVLAIR

SEQ ID NO: 977 - protein, 6 aa, Homo sapiens
LLEYYR

SEQ ID NO: 978 - protein, 15 aa, Homo sapiens
LYNTLDDLLLYINAR

SEQ ID NO: 979 - protein, 21 aa, Homo sapiens
LYVYNDGYLLNYDLSVLQKPQ

SEQ ID NO: 980 - protein, 15 aa, Homo sapiens
QCSVSLPDTTFPVDR

SEQ ID NO: 981 - protein, 10 aa, Homo sapiens
QYKPSASNAF

SEQ ID NO: 982 - protein, 20 aa, Homo sapiens
QYKPSASNAFMVCGVLYATR

SEQ ID NO: 983 - protein, 13 aa, Homo sapiens
SVSLPDTTFPVDR

SEQ ID NO: 984 - protein, 16 aa, Homo sapiens
TIAVTQTLPNAAYNNR

SEQ ID NO: 985 - protein, 10 aa, Homo sapiens
WVAPLNTDGR

SEQ ID NO: 986 - protein, 14 aa, Homo sapiens
TEEIFYYYDTNTGK

SEQ ID NO: 987 - protein, 12 aa, Homo sapiens
VQSINYNPFDQK

SEQ ID NO: 988 - protein, 8 aa, Homo sapiens
YYDTNTGK

SEQ ID NO: 989 - protein, 13 aa, Homo sapiens
LLNYDLSVLQKPQ

SEQ ID NO: 990 - protein, 9 aa, Homo sapiens
YYYDTNTGK

SEQ ID NO: 991 - protein, 8 aa, Homo sapiens
LKECEASK

SEQ ID NO: 992 - protein, 6 aa, Homo sapiens
EIVALK

SEQ ID NO: 993 - protein, 6 aa, Homo sapiens
IDIMEK

SEQ ID NO: 994 - protein, 6 aa, Homo sapiens
LETLDK

SEQ ID NO: 995 - protein, 19 aa, Homo sapiens
VYNDGYLLNYDLSVLQKPQ

SEQ ID NO: 996 - protein, 7 aa, Homo sapiens
YNPFDQK

SEQ ID NO: 997 - protein, 11 aa, Homo sapiens
LYNTLDDLLLY

SEQ ID NO: 998 - protein, 33 aa, Homo sapiens
VNMYNTGNIARVNLTTNTIAVTQTLPNAAYNNR

SEQ ID NO: 999 - protein, 510 aa, Homo sapiens
MRPGLSFLLALLFFLGQAAGDLGDVGPPIPSPGFSSFPGVDSSSSFSSSSRSGSSSSRSLGSGGSVSQLFSNFTGSVDDRGTCQCSVSLPDTTFPVDRVERLEFTAHVLSQKFEKELSKVREYVQLISVYEKKLLNLTVRIDIMEKDTISYTELDFELIKVEVKEMEKLVIQLKESFGGSSEIVDQLEVEIRNMTLLVEKLETLDKNNVLAIRREIVALKTKLKECEASKDQNTPVVHPPPTPGSCGHGGVVNISKPSVVQLNWRGFSYLYGAWGRDYSPQHPNKGLYWVAPLNTDGRLLEYYRLYNTLDDLLLYINARELRITYGQGSGTAVYNNNMYVNMYNTGNIARVNLTTNTIAVTQTLPNAAYNNRFSYANVAWQDIDFAVDENGLWVIYSTEASTGNMVISKLNDTTLQVLNTWYTKQYKPSASNAFMVCGVLYATRTMNTRTEEIFYYYDTNTGKEGKLDIVMHKMQEKVQSINYNPFDQKLYVYNDGYLLNYDLSVLQKPQ

SEQ ID NO: 1000 - protein, 13 aa, Homo sapiens
TDCPGDALFDLLR

SEQ ID NO: 1001 - protein, 576 aa, Homo sapiens
MAQGVLWILLGLLLWSDPGTASLPLLMDSVIQALAELEQKVPAAKTRHTASAWLMSAPNSGPHNRLYHFLLGAWSLNATELDPCPLSPELLGLTKEVARHDVREGKEYGVVLAPDGSTVAVEPLLAGLEAGLQGRRVINLPLDSMAAPWETGDTFPDVVAIAPDVRATSSPGLRDGSPDVTTADIGANTPDATKGCPDVQASLPDAKAKSPPTMVDSLLAVTLAGNLGLTFLRGSQTQSHPDLGTEGCWDQLSAPRTFTLLDPKASLLTMAFLNGALDGVILGDYLSRTPEPRPSLSHLLSQYYGAGVARDPGFRSNFRRQNGAALTSASILAQQVWGTLVLLQRLEPVHLQLQCMSQEQLAQVAANATKEFTEAFLGCPAIHPRCRWGAAPYRGRPKLLQLPLGFLYVHHTYVPAPPCTDFTRCAANMRSMQRYHQDTQGWGDIGYSFVVGSDGYVYEGRGWHWVGAHTLGHNSRGFGVAIVGNYTAALPTEAALRTVRDTLPSCAVRAGLLRPDYALLGHRQLVRTDCPGDALFDLLRTWPHFTATVKPRPARSVSKRSRREPPPRTLPATDLQ

SEQ ID NO: 1002 - protein, 13 aa, Homo sapiens
VETPVLPPVLVPR

SEQ ID NO: 1003 - protein, 21 aa, Homo sapiens
GTGGVDTAAVGGVFDVSNADR

SEQ ID NO: 1004 - protein, 23 aa, Homo sapiens
TDLNPDNLQGGDDLDPNYVLSSR

SEQ ID NO: 1005 - protein, 13 aa, Homo sapiens
TFLVWVNEEDHLR

SEQ ID NO: 1006 - protein, 381 aa, Homo sapiens
MPFSNSHNALKLRFPAEDEFPDLSAHNNHMAKVLTPELYAELRAKSTPSGFTLDDVIQTGVDNPGHPYIMTVGCVAGDEESYEVFKDLFDPIIEDRHGGYKPSDEHKTDLNPDNLQGGDDLDPNYVLSSRVRTGRSIRGFCLPPHCSRGERRAIEKLAVEALSSLDGDLAGRYYALKSMTEAEQQQLIDDHFLFDKPVSPLLLASGMARDWPDARGIWHNDNKTFLVWVNEEDHLRVISMQKGGNMKEVFTRFCTGLTQIETLFKSKDYEFMWNPHLGYILTCPSNLGTGLRAGVHIKLPNLGKHEKFSEVLKRLRLQKRGTGGVDTAAVGGVFDVSNADRLGFSEVELVQMVVDGVKLLIEMEQRLEQGQAIDDLMPAQK

SEQ ID NO: 1007 - protein, 18 aa, Homo sapiens
AEAAASALADADADLEER

SEQ ID NO: 1008 - protein, 19 aa, Homo sapiens
KAEAAASALADADADLEER

SEQ ID NO: 1009 - protein, 7 aa, Homo sapiens
KIIADIK

SEQ ID NO: 1010 - protein, 18 aa, Homo sapiens
LQQAVMLGALTEVPVPTR

SEQ ID NO: 1011 - protein, 16 aa, Homo sapiens
ILVATDASFLVQYFTR

SEQ ID NO: 1012 - protein, 1035 aa, Homo sapiens
MSTENVEGKPSNLGERGRARSSTFLRVVQPMFNHSIFTSAVSPAAERIRFILGEEDDSPAPPQLFTELDELLAVDGQEMEWKETARWIKFEEKVEQGGERWSKPHVATLSLHSLFELRTCMEKGSIMLDREASSLPQLVEMIVDHQIETGLLKPELKDKVTYTLLRKHRHQTKKSNLRSLADIGKTVSSASRMFTNPDNGSPAMTHRNLTSSSLNDISDKPEKDQLKNKFMKKLPRDAEASNVLVGEVDFLDTPFIAFVRLQQAVMLGALTEVPVPTRFLFILLGPKGKAKSYHEIGRAIATLMSDEVFHDIAYKAKDRHDLIAGIDEFLDEVIVLPPGEWDPAIRIEPPKSLPSSDKRKNMYSGGENVQMNGDTPHDGGHGGGGHGDCEELQRTGRFCGGLIKDIKRKAPFFASDFYDALNIQALSAILFIYLATVTNAITFGGLLGDATDNMQGVLESFLGTAVSGAIFCLFAGQPLTILSSTGPVLVFERLLFNFSKDNNFDYLEFRLWIGLWSAFLCLILVATDASFLVQYFTRFTEEGFSSLISFIFIYDAFKKMIKLADYYPINSNFKVGYNTLFSCTCVPPDPANISISNDTTLAPEYLPTMSSTDMYHNTTFDWAFLSKKECSKYGGNLVGNNCNFVPDITLMSFILFLGTYTSSMALKKFKTSPYFPTTARKLISDFAIILSILIFCVIDALVGVDTPKLIVPSEFKPTSPNRGWFVPPFGENPWWVCLAAAIPALLVTILIFMDQQITAVIVNRKEHKLKKGAGYHLDLFWVAILMVICSLMALPWYVAATVISIAHIDSLKMETETSAPGEQPKFLGVREQRVTGTLVFILTGLSVFMAPILKFIPMPVLYGVFLYMGVASLNGVQFMDRLKLLLMPLKHQPDFIYLRHVPLRRVHLFTFLQVLCLALLWILKSTVAAIIFPVMILALVAVRKGMDYLFSQHDLSFLDDVIPEKDKKKKEDEKKKKKKKGSLDSDNDDSDCPYSEKVPSIKIPMDIMEQQPFLSDSKPSDRERSPTFLERHTSC

SEQ ID NO: 1013 - protein, 15 aa, Homo sapiens
FLEQELETITIPDLR

SEQ ID NO: 1014 - protein, 493 aa, Homo sapiens
MALFGALFLALLAGAHAEFPGCKIRVTSKALELVKQEGLRFLEQELETITIPDLRGKEGHFYYNISEVKVTELQLTSSELDFQPQQELMLQITNASLGLRFRRQLLYWFFYDGGYINASAEGVSIRTGLELSRDPAGRMKVSNVSCQASVSRMHAAFGGTFKKVYDFLSTFITSGMRFLLNQQICPVLYHAGTVLLNSLLDTVPVRSSVDELVGIDYSLMKDPVASTSNLDMDFRGAFFPLTERNWSLPNRAVEPQLQEEERMVYVAFSEFFFDSAMESYFRAGALQLLLVGDKVPHDLDMLLRATYFGSIVLLSPAVIDSPLKLELRVLAPPRCTIKPSGTTISVTASVTIALVPPDQPEVQLSSMTMDARLSAKMALRGKALRTQLDLRRFRIYSNHSALESLALIPLQAPLKTMLQIGVMPMLNERTWRGVQIPLPEGINFVHEVVTNHAGFLTIGADLHFAKGLREVIEKNRPADVRASTAPTPSTAAV

SEQ ID NO: 1015 - protein, 20 aa, Homo sapiens
AEEEHLGILGPQLHADVGDK

SEQ ID NO: 1016 - protein, 12 aa, Homo sapiens
ALYLQYTDETFR

SEQ ID NO: 1017 - protein, 11 aa, Homo sapiens
DIFTGLIGPMK

SEQ ID NO: 1018 - protein, 14 aa, Homo sapiens
DLYSGLIGPLIVCR

SEQ ID NO: 1019 - protein, 26 aa, Homo sapiens
DVDKEFYLFPTVFDENESLLLEDNIR

SEQ ID NO: 1020 - protein, 22 aa, Homo sapiens
EFYLFPTVFDENESLLLEDNIR

SEQ ID NO: 1021 - protein, 13 aa, Homo sapiens
GAYPLSIEPIGVR

SEQ ID NO: 1022 - protein, 23 aa, Homo sapiens
GPEEEHLGILGPVIWAEVGDTIR

SEQ ID NO: 1023 - protein, 23 aa, Homo sapiens
GVYSSDVFDIFPGTYQTLEMFPR

SEQ ID NO: 1024 - protein, 10 aa, Homo sapiens
IYHSHIDAPK

SEQ ID NO: 1025 - protein, 21 aa, Homo sapiens
KAEEEHLGILGPQLHADVGDK

SEQ ID NO: 1026 - protein, 19 aa, Homo sapiens
LFPTVFDENESLLLEDNIR

SEQ ID NO: 1027 - protein, 21 aa, Homo sapiens
MFTTAPDQVDKEDEDFQESNK

SEQ ID NO: 1028 - protein, 20 aa, Homo sapiens
MLLATEEQSPGEGDGNCVTR

SEQ ID NO: 1029 - protein, 17 aa, Homo sapiens
SVPPSASHVAPTETFTY

SEQ ID NO: 1030 - protein, 17 aa, Homo sapiens
TTIEKPVWLGFLGPIIK

SEQ ID NO: 1031 - protein, 13 aa, Homo sapiens
VNKDDEEFIESNK

SEQ ID NO: 1032 - protein, 20 aa, Homo sapiens
YLFPTVFDENESLLLEDNIR

SEQ ID NO: 1033 - protein, 6 aa, Homo sapiens
VTFHNK

SEQ ID NO: 1034 - protein, 15 aa, Homo sapiens
GPEEEHLGILGPVIW

SEQ ID NO: 1035 - protein, 1065 aa, Homo sapiens
MKILILGIFLFLCSTPAWAKEKHYYIGIIETTWDYASDHGEKKLISVDTEHSNIYLQNGPDRIGRLYKKALYLQYTDETFRTTIEKPVWLGFLGPIIKAETGDKVYVHLKNLASRPYTFHSHGITYYKEHEGAIYPDNTTDFQRADDKVYPGEQYTYMLLATEEQSPGEGDGNCVTRIYHSHIDAPKDIASGLIGPLIICKKDSLDKEKEKHIDREFVVMFSVVDENFSWYLEDNIKTYCSEPEKVDKDNEDFQESNRMYSVNGYTFGSLPGLSMCAEDRVKWYLFGMGNEVDVHAAFFHGQALTNKNYRIDTINLFPATLFDAYMVAQNPGEWMLSCQNLNHLKAGLQAFFQVQECNKSSSKDNIRGKHVRHYYIAAEEIIWNYAPSGIDIFTKENLTAPGSDSAVFFEQGTTRIGGSYKKLVYREYTDASFTNRKERGPEEEHLGILGPVIWAEVGDTIRVTFHNKGAYPLSIEPIGVRFNKNNEGTYYSPNYNPQSRSVPPSASHVAPTETFTYEWTVPKEVGPTNADPVCLAKMYYSAVDPTKDIFTGLIGPMKICKKGSLHANGRQKDVDKEFYLFPTVFDENESLLLEDNIRMFTTAPDQVDKEDEDFQESNKMHSMNGFMYGNQPGLTMCKGDSVVWYLFSAGNEADVHGIYFSGNTYLWRGERRDTANLFPQTSLTLHMWPDTEGTFNVECLTTDHYTGGMKQKYTVNQCRRQSEDSTFYLGERTYYIAAVEVEWDYSPQREWEKELHHLQEQNVSNAFLDKGEFYIGSKYKKVVYRQYTDSTFRVPVERKAEEEHLGILGPQLHADVGDKVKIIFKNMATRPYSIHAHGVQTESSTVTPTLPGETLTYVWKIPERSGAGTEDSACIPWAYYSTVDQVKDLYSGLIGPLIVCRRPYLKVFNPRRKLEFALLFLVFDENESWYLDDNIKTYSDHPEKVNKDDEEFIESNKMHAINGRMFGNLQGLTMHVGDEVNWYLMGMGNEIDLHTVHFHGHSFQYKHRGVYSSDVFDIFPGTYQTLEMFPRTPGIWLLHCHVTDHIHAGMETTYTVLQNEDTKSG

SEQ ID NO: 1036 - protein, 21 aa, Homo sapiens
GGSGELLENTMEAMENSMAQR

SEQ ID NO: 1037 - protein, 12 aa, Homo sapiens
SDLLELDCQLTR

SEQ ID NO: 1038 - protein, 14 aa, Homo sapiens
DVGSLDFEDLPLYK

SEQ ID NO: 1039 - protein, 12 aa, Homo sapiens
VVVVSHDENLCR

SEQ ID NO: 1040 - protein, 318 aa, Homo sapiens
MSLLLYYALPALGSYAMLSIFFLRRPHLLHTPRAPTFRIRLGAHRGGSGELLENTMEAMENSMAQRSDLLELDCQLTRDRVVVVSHDENLCRQSGLNRDVGSLDFEDLPLYKEKLEVYFSPGHFAHGSDRRMVRLEDLFQRFPRTPMSVEIKGKNEELIREIAGLVRRYDRNEITIWASEKSSVMKKCKAANPEMPLSFTISRGFWVLLSYYLGLLPFIPIPEKFFFCFLPNIINRTYFPFSCSCLNQLLAVVSKWLIMRKSLIRHLEERGVQVVFWCLNEESDFEAAFSVGATGVITDYPTALRHYLDNHGPAARTS

SEQ ID NO: 1041 - protein, 9 aa, Homo sapiens
GFDWPLLVK

SEQ ID NO: 1042 - protein, 13 aa, Homo sapiens
NFADFMTEQSPTR

SEQ ID NO: 1043 - protein, 21 aa, Homo sapiens
YVVGELIWNFADFMTEQSPTR

SEQ ID NO: 1044 - protein, 16 aa, Homo sapiens
TSHYPYAEEVMQMCDR

SEQ ID NO: 1045 - protein, 651 aa, Homo sapiens
MARGSAVAWAALGPLLWGCALGLQGGMLYPQESPSRECKELDGLWSFRADFSDNRRRGFEEQWYRRPLWESGPTVDMPVPSSFNDISQDWRLRHFVGWVWYEREVILPERWTQDLRTRVVLRIGSAHSYAIVWVNGVDTLEHEGGYLPFEADISNLVQVGPLPSRLRITIAINNTLTPTTLPPGTIQYLTDTSKYPKGYFVQNTYFDFFNYAGLQRSVLLYTTPTTYIDDITVTTSVEQDSGLVNYQISVKGSNLFKLEVRLLDAENKVVANGTGTQGQLKVPGVSLWWPYLMHERPAYLYSLEVQLTAQTSLGPVSDFYTLPVGIRTVAVTKSQFLINGKPFYFHGVNKHEDADIRGKGFDWPLLVKDFNLLRWLGANAFRTSHYPYAEEVMQMCDRYGIVVIDECPGVGLALPQFFNNVSLHHHMQVMEEVVRRDKNHPAVVMWSVANEPASHLESAGYYLKMVIAHTKSLDPSRPVTFVSNSNYAADKGAPYVDVICLNSYYSWYHDYGHLELIQLQLATQFENWYKKYQKPIIQSEYGAETIAGFHQDPPLMFTEEYQKSLLEQYHLGLDQKRRKYVVGELIWNFADFMTEQSPTRVLGNKKGIFTRQRQPKSAAFLLRERYWKIANETRYPHSVAKSQCLENSPFT

SEQ ID NO: 1046 - protein, 13 aa, Homo sapiens
ADFLEQPVLGFVR

SEQ ID NO: 1047 - protein, 17 aa, Homo sapiens
LQEAAELEAVELPVPIR

SEQ ID NO: 1048 - protein, 911 aa, Homo sapiens
MEELQDDYEDMMEENLEQEEYEDPDIPESQMEEPAAHDTEATATDYHTTSHPGTHKVYVELQELVMDEKNQELRWMEAARWVQLEENLGENGAWGRPHLSHLTFWSLLELRRVFTKGTVLLDLQETSLAGVANQLLDRFIFEDQIRPQDREELLRALLLKHSHAGELEALGGVKPAVLTRSGDPSQPLLPQHSSLETQLFCEQGDGGTEGHSPSGILEKIPPDSEATLVLVGRADFLEQPVLGFVRLQEAAELEAVELPVPIRFLFVLLGPEAPHIDYTQLGRAAATLMSERVFRIDAYMAQSRGELLHSLEGFLDCSLVLPPTDAPSEQALLSLVPVQRELLRRRYQSSPAKPDSSFYKGLDLNGGPDDPLQQTGQLFGGLVRDIRRRYPYYLSDITDAFSPQVLAAVIFIYFAALSPAITFGGLLGEKTRNQMGVSELLISTAVQGILFALLGAQPLLVVGFSGPLLVFEEAFFSFCETNGLEYIVGRVWIGFWLILLVVLVVAFEGSFLVRFISRYTQEIFSFLISLIFIYETFSKLIKIFQDHPLQKTYNYNVLMVPKPQGPLPNTALLSLVLMAGTFFFAMMLRKFKNSSYFPGKLRRVIGDFGVPISILIMVLVDFFIQDTYTQKLSVPDGFKVSNSSARGWVIHPLGLRSEFPIWMMFASALPALLVFILIFLESQITTLIVSKPERKMVKGSGFHLDLLLVVGMGGVAALFGMPWLSATTVRSVTHANALTVMGKASTPGAAAQIQEVKEQRISGLLVAVLVGLSILMEPILSRIPLAVLFGIFLYMGVTSLSGIQLFDRILLLFKPPKYHPDVPYVKRVKTWRMHLFTGIQIICLAVLWVVKSTPASLALPFVLILTVPLRRVLLPLIFRNVELQCLDADDAKATFDEEEGRDEYDEVAMPV

SEQ ID NO: 1049 - protein, 17 aa, Homo sapiens
GGLPLEEVTVAEVLAAR

SEQ ID NO: 1050 - protein, 14 aa, Homo sapiens
YMAFAHDLMADAQR

SEQ ID NO: 1051 - protein, 13 aa, Homo sapiens
ATKGIVEHDFVIK

SEQ ID NO: 1052 - protein, 381 aa, Homo sapiens
MSGVVRTLSRCLLPAEAGGARERRAGSGARDAEREARRRSRDIDALLARERRAVRRLVKILLLGAGESGKSTFLKQMRIIHGREFDQKALLEFRDTIFDNILKGSRVLVDARDKLGIPWQYSENEKHGMFLMAFENKAGLPVEPATFQLYVPALSALWRDSGIREAFSRRSEFQLGESVKYFLDNLDRIGQLNYFPSKQDILLARKATKGIVEHDFVIKKIPFKMVDVGGQRSQRQKWFQCFDGITSILFMVSSSEYDQVLMEDRRTNRLVESMNIFETIVNNKLFFNVSIILFLNKMDLLVEKVKTVSIKKHFPDFRGDPHRLEDVQRYLVQCFDRKRRNRSKPLFHHFTTAIDTENVRFVFHAVKDTILQENLKDIMLQ

SEQ ID NO: 1053 - protein, 18 aa, Homo sapiens
TGSTPEVSTVDAMLDLIR

SEQ ID NO: 1054 - protein, 524 aa, Homo sapiens
MGKPARKGCEWKRFLKNNWVLLSTVAAVVLGITTGVLVREHSNLSTLEKFYFAFPGEILMRMLKLIILPLIISSMITGVAALDSNVSGKIGLRAVVYYFCTTLIAVILGIVLVVSIKPGVTQKVGEIARTGSTPEVSTVDAMLDLIRNMFPENLVQACFQQYKTKREEVKPPSDPEMNMTEESFTAVMTTAISKNKTKEYKIVGMYSDGINVLGLIVFCLVFGLVIGKMGEKGQILVDFFNALSDATMKIVQIIMCYMPLGILFLIAGKIIEVEDWEIFRKLGLYMATVLTGLAIHSIVILPLIYFIVVRKNPFRFAMGMAQALLTALMISSSSATLPVTFRCAEENNQVDKRITRFVLPVGATINMDGTALYEAVAAVFIAQLNDLDLGIGQIITISITATSASIGAAGVPQAGLVTMVIVLSAVGLPAEDVTLIIAVDWLLDRFRTMVNVLGDAFGTGIVEKLSKKELEQMDVSSEVNIVNPFALESTILDNEDSDTKKSYVNGGFAVDKSDTISFTQTSQF

SEQ ID NO: 1055 - protein, 16 aa, Homo sapiens
HGVQELEIELQSQLSK

SEQ ID NO: 1056 - protein, 24 aa, Homo sapiens
SYGGGSGGGFSASSLGGGFGGGSR

SEQ ID NO: 1057 - protein, 623 aa, Homo sapiens
MSCRQFSSSYLSRSGGGGGGGLGSGGSIRSSYSRFSSSGGGGGGGRFSSSSGYGGGSSRVCGRGGGGSFGYSYGGGSGGGFSASSLGGGFGGGSRGFGGASGGGYSSSGGFGGGFGGGSGGGFGGGYGSGFGGFGGFGGGAGGGDGGILTANEKSTMQELNSRLASYLDKVQALEEANNDLENKIQDWYDKKGPAAIQKNYSPYYNTIDDLKDQIVDLTVGNNKTLLDIDNTRMTLDDFRIKFEMEQNLRQGVDADINGLRQVLDNLTMEKSDLEMQYETLQEELMALKKNHKEEMSQLTGQNSGDVNVEINVAPGKDLTKTLNDMRQEYEQLIAKNRKDIENQYETQITQIEHEVSSSGQEVQSSAKEVTQLRHGVQELEIELQSQLSKKAALEKSLEDTKNRYCGQLQMIQEQISNLEAQITDVRQEIECQNQEYSLLLSIKMRLEKEIETYHNLLEGGQEDFESSGAGKIGLGGRGGSGGSYGRGSRGGSGGSYGGGGSGGGYGGGSGSRGGSGGSYGGGSGSGGGSGGGYGGGSGGGHSGGSGGGHSGGSGGNYGGGSGSGGGSGGGYGGGSGSRGGSGGSHGGGSGFGGESGGSYGGGEEASGSGGGYGGGSGKSSHS

SEQ ID NO: 1058 - protein, 14 aa, Homo sapiens
DPVQEAWAEDVDLR

SEQ ID NO: 1059 - protein, 15 aa, Homo sapiens
FDEILEASDGIMVAR

SEQ ID NO: 1060 - protein, 9 aa, Homo sapiens
HLQLFEELR

SEQ ID NO: 1061 - protein, 11 aa, Homo sapiens
LDIDSPPITAR

SEQ ID NO: 1062 - protein, 531 aa, Homo sapiens
MSKPHSEAGTAFIQTQQLHAAMADTFLEHMCRLDIDSPPITARNTGIICTIGPASRSVETLKEMIKSGMNVARLNFSHGTHEYHAETIKNVRTATESFASDPILYRPVAVALDTKGPEIRTGLIKGSGTAEVELKKGATLKITLDNAYMEKCDENILWLDYKNICKVVEVGSKIYVDDGLISLQVKQKGADFLVTEVENGGSLGSKKGVNLPGAAVDLPAVSEKDIQDLKFGVEQDVDMVFASFIRKASDVHEVRKVLGEKGKNIKIISKIENHEGVRRFDEILEASDGIMVARGDLGIEIPAEKVFLAQKMMIGRCNRAGKPVICATQMLESMIKKPRPTRAEGSDVANAVLDGADCIMLSGETAKGDYPLEAVRMQHLIAREAEAAIYHLQLFEELRRLAPITSDPTEATAVGAVEASFKCCSGAIIVLTKSGRSAHQVARYRPRAPIIAVTRNPQTARQAHLYRGIFPVLCKDPVQEAWAEDVDLRVNFAMNVGKARGFFKKGDVVIVLTGWRPGSGFTNTMRVVPVP

SEQ ID NO: 1063 - protein, 17 aa, Homo sapiens
DHPGETEVPLDLPADSR

SEQ ID NO: 1064 - protein, 30 aa, Homo sapiens
IYQNIQDGSLDLNAAESGVQHKPSAPQGGR

SEQ ID NO: 1065 - protein, 215 aa, Homo sapiens
MATAPYNYSYIFKYIIIGDMGVGKSCLLHQFTEKKFMADCPHTIGVEFGTRIIEVSGQKIKLQIWDTAGQERFRAVTRSYYRGAAGALMVYDITRRSTYNHLSSWLTDARNLTNPNTVIILIGNKADLEAQRDVTYEEAKQFAEENGLLFLEASAKTGENVEDAFLEAAKKIYQNIQDGSLDLNAAESGVQHKPSAPQGGRLTSEPQPQREGCGC

SEQ ID NO: 1066 - protein, 16 aa, Homo sapiens
HQDFNSAVQLVENFCR

SEQ ID NO: 1067 - protein, 19 aa, Homo sapiens
SEGSSVNLSPPLEQCVPDR

SEQ ID NO: 1068 - protein, 17 aa, Homo sapiens
TFGSGEADCGLRPLFEK

SEQ ID NO: 1069 - protein, 622 aa, Homo sapiens
MAHVRGLQLPGCLALAALCSLVHSQHVFLAPQQARSLLQRVRRANTFLEEVRKGNLERECVEETCSYEEAFEALESSTATDVFWAKYTACETARTPRDKLAACLEGNCAEGLGTNYRGHVNITRSGIECQLWRSRYPHKPEINSTTHPGADLQENFCRNPDSSTTGPWCYTTDPTVRRQECSIPVCGQDQVTVAMTPRSEGSSVNLSPPLEQCVPDRGQQYQGRLAVTTHGLPCLAWASAQAKALSKHQDFNSAVQLVENFCRNPDGDEEGVWCYVAGKPGDFGYCDLNYCEEAVEEETGDGLDEDSDRAIEGRTATSEYQTFFNPRTFGSGEADCGLRPLFEKKSLEDKTERELLESYIDGRIVEGSDAEIGMSPWQVMLFRKSPQELLCGASLISDRWVLTAAHCLLYPPWDKNFTENDLLVRIGKHSRTRYERNIEKISMLEKIYIHPRYNWRENLDRDIALMKLKKPVAFSDYIHPVCLPDRETAASLLQAGYKGRVTGWGNLKETWTANVGKGQPSVLQVVNLPIVERPVCKDSTRIRITDNMFCAGYKPDEGKRGDACEGDSGGPFVMKSPFNNRWYQMGIVSWGEGCDRDGKYGFYTHVFRLKKWIQKVIDQFGE

SEQ ID NO: 1070 - protein, 13 aa, Homo sapiens
AINQGGLTSVAVR

SEQ ID NO: 1071 - protein, 17 aa, Homo sapiens
ILTEAEIDAHLVALAER

SEQ ID NO: 1072 - protein, 246 aa, Homo sapiens
MSRGSSAGFDRHITIFSPEGRLYQVEYAFKAINQGGLTSVAVRGKDCAVIVTQKKVPDKLLDSSTVTHLFKITENIGCVMTGMTADSRSQVQRARYEAANWKYKYGYEIPVDMLCKRIADISQVYTQNAEMRPLGCCMILIGIDEEQGPQVYKCDPAGYYCGFKATAAGVKQTESTSFLEKKVKKKFDWTFEQTVETAITCLSTVLSIDFKPSEIEVGVVTVENPKFRILTEAEIDAHLVALAERD

SEQ ID NO: 1073 - protein, 18 aa, Homo sapiens
GHYTEGAELVDSVLDVVR

SEQ ID NO: 1074 - protein, 15 aa, Homo sapiens
AVLVDLEPGTMDSVR

SEQ ID NO: 1075 - protein, 445 aa, Homo sapiens
MREIVHLQAGQCGNQIGAKFWEVISDEHGIDPTGTYHGDSDLQLERINVYYNEATGGKYVPRAVLVDLEPGTMDSVRSGPFGQIFRPDNFVFGQSGAGNNWAKGHYTEGAELVDSVLDVVRKEAESCDCLQGFQLTHSLGGGTGSGMGTLLISKIREEYPDRIMNTFSVVPSPKVSDTVVEPYNATLSVHQLVENTDETYCIDNEALYDICFRTLKLTTPTYGDLNHLVSATMSGVTTCLRFPGQLNADLRKLAVNMVPFPRLHFFMPGFAPLTSRGSQQYRALTVPELTQQMFDAKNMMAACDPRHGRYLTVAAVFRGRMSMKEVDEQMLNVQNKNSSYFVEWIPNNVKTAVCDIPPRGLKMSATFIGNSTAIQELFKRISEQFTAMFRRKAFLHWYTGEGMDEMEFTEAESNMNDLVSEYQQYQDATAEEEGEFEEEAEEEVA

SEQ ID NO: 1076 - protein, 18 aa, Homo sapiens
IPSLAELETIEQEEASSR

SEQ ID NO: 1077 - protein, 20 aa, Homo sapiens
IPSLAELETIEQEEASSRPK

SEQ ID NO: 1078 - protein, 11 aa, Homo sapiens
LVLPNPGLDAR

SEQ ID NO: 1079 - protein, 10 aa, Homo sapiens
VLPNPGLDAR

SEQ ID NO: 1080 - protein, 634 aa, Homo sapiens
MVRLVLPNPGLDARIPSLAELETIEQEEASSRPKWDNKAQYMLTCLGFCVGLGNVWRFPYLCQSHGGGAFMIPFLILLVLEGIPLLYLEFAIGQRLRRGSLGVWSSIHPALKGLGLASMLTSFMVGLYYNTIISWIMWYLFNSFQEPLPWSDCPLNENQTGYVDECARSSPVDYFWYRETLNISTSISDSGSIQWWMLLCLACAWSVLYMCTIRGIETTGKAVYITSTLPYVVLTIFLIRGLTLKGATNGIVFLFTPNVTELAQPDTWLDAGAQVFFSFSLAFGGLISFSSYNSVHNNCEKDSVIVSIINGFTSVYVAIVVYSVIGFRATQRYDDCFSTNILTLINGFDLPEGNVTQENFVDMQQRCNASDPAAYAQLVFQTCDINAFLSEAVEGTGLAFIVFTEAITKMPLSPLWSVLFFIMLFCLGLSSMFGNMEGVVVPLQDLRVIPPKWPKEVLTGLICLGTFLIGFIFTLNSGQYWLSLLDSYAGSIPLLIIAFCEMFSVVYVYGVDRFNKDIEFMIGHKPNIFWQVTWRVVSPLLMLIIFLFFFVVEVSQELTYSIWDPGYEEFPKSQKISYPNWVYVVVVIVAGVPSLTIPGYAIYKLIRNHCQKPGDHQGLVSTLSTASMNGDLKY

SEQ ID NO: 1081 - protein, 19 aa, Homo sapiens
EIYCPAPPQIDNGIIQGER

SEQ ID NO: 1082 - protein, 18 aa, Homo sapiens
DCGLPPDVPNAQPALEGR

SEQ ID NO: 1083 - protein, 18 aa, Homo sapiens
AIAQGGEEEWDFAWEQFR

SEQ ID NO: 1084 - protein, 15 aa, Homo sapiens
AQIINDAFNLASAHK

SEQ ID NO: 1085 - protein, 28 aa, Homo sapiens
ASSHPLSTPASEINTPAQISELFDAISY

SEQ ID NO: 1086 - protein, 20 aa, Homo sapiens
CNAIAQGGEEEWDFAWEQFR

SEQ ID NO: 1087 - protein, 8 aa, Homo sapiens
DFAWEQFR

SEQ ID NO: 1088 - protein, 8 aa, Homo sapiens
DFVQSNWK

SEQ ID NO: 1089 - protein, 10 aa, Homo sapiens
DHSAIPVINR

SEQ ID NO: 1090 - protein, 10 aa, Homo sapiens
DLMVLNDVYR

SEQ ID NO: 1091 - protein, 11 aa, Homo sapiens
DLTALSNMLPK

SEQ ID NO: 1092 - protein, 9 aa, Homo sapiens
ELQQLEQFK

SEQ ID NO: 1093 - protein, 7 aa, Homo sapiens
ELWILNR

SEQ ID NO: 1094 - protein, 16 aa, Homo sapiens
ENSLLFDPLSSSSSNK

SEQ ID NO: 1095 - protein, 12 aa, Homo sapiens
EVVLQWFTENSK

SEQ ID NO: 1096 - protein, 14 aa, Homo sapiens
FFAGHYDTPYPLPK

SEQ ID NO: 1097 - protein, 14 aa, Homo sapiens
FSTEYELQQLEQFK

SEQ ID NO: 1098 - protein, 15 aa, Homo sapiens
FSTEYELQQLEQFKK

SEQ ID NO: 1099 - protein, 21 aa, Homo sapiens
GVGGSQPPDIDKTELVEPTEY

SEQ ID NO: 1100 - protein, 27 aa, Homo sapiens
GVGGSQPPDIDKTELVEPTEYLVVHLK

SEQ ID NO: 1101 - protein, 10 aa, Homo sapiens
IVSEFDYVEK

SEQ ID NO: 1102 - protein, 8 aa, Homo sapiens
KIQTQLQR

SEQ ID NO: 1103 - protein, 22 aa, Homo sapiens
KLFNDYGGGSFSFSNLIQAVTR

SEQ ID NO: 1104 - protein, 11 aa, Homo sapiens
KQVTPLFIHFR

SEQ ID NO: 1105 - protein, 14 aa, Homo sapiens
KVVATTQMQAADAR

SEQ ID NO: 1106 - protein, 21 aa, Homo sapiens
LFNDYGGGSFSFSNLIQAVTR

SEQ ID NO: 1107 - protein, 14 aa, Homo sapiens
LLAFIVSEFDYVEK

SEQ ID NO: 1108 - protein, 11 aa, Homo sapiens
LPNTLKPDSYR

SEQ ID NO: 1109 - protein, 12 aa, Homo sapiens
MLSSFLSEDVFK

SEQ ID NO: 1110 - protein, 19 aa, Homo sapiens
NAIAQGGEEEWDFAWEQFR

SEQ ID NO: 1111 - protein, 12 aa, Homo sapiens
NYVWIVPITSIR

SEQ ID NO: 1112 - protein, 16 aa, Homo sapiens
PSEFNYVWIVPITSIR

SEQ ID NO: 1113 - protein, 11 aa, Homo sapiens
QQQDYWLIDVR

SEQ ID NO: 1114 - protein, 10 aa, Homo sapiens
QVTPLFIHFR

SEQ ID NO: 1115 - protein, 14 aa, Homo sapiens
QWMENPNNNPIHPN

SEQ ID NO: 1116 - protein, 16 aa, Homo sapiens
QWMENPNNNPIHPNLR

SEQ ID NO: 1117 - protein, 16 aa, Homo sapiens
QYMPWEAALSSLSYFK

SEQ ID NO: 1118 - protein, 15 aa, Homo sapiens
RFSTEYELQQLEQFK

SEQ ID NO: 1119 - protein, 23 aa, Homo sapiens
SDQIGLPDFNAGAMENWGLVTYR

SEQ ID NO: 1120 - protein, 11 aa, Homo sapiens
SFPCFDEPAMK

SEQ ID NO: 1121 - protein, 11 aa, Homo sapiens
SFSNLIQAVTR

SEQ ID NO: 1122 - protein, 9 aa, Homo sapiens
SIQLPTTVR

SEQ ID NO: 1123 - protein, 24 aa, Homo sapiens
STVYCNAIAQGGEEEWDFAWEQFR

SEQ ID NO: 1124 - protein, 25 aa, Homo sapiens
VKDSQYEMDSEFEGELADDLAGFYR

SEQ ID NO: 1125 - protein, 9 aa, Homo sapiens
VNYDEENWR

SEQ ID NO: 1126 - protein, 13 aa, Homo sapiens
VVATTQMQAADAR

SEQ ID NO: 1127 - protein, 10 aa, Homo sapiens
VWIVPITSIR

SEQ ID NO: 1128 - protein, 12 aa, Homo sapiens
YLSYTLNPDLIR

SEQ ID NO: 1129 - protein, 23 aa, Homo sapiens
DSQYEMDSEFEGELADDLAGFYR

SEQ ID NO: 1130 - protein, 12 aa, Homo sapiens
AGHYDTPYPLPK

SEQ ID NO: 1131 - protein, 11 aa, Homo sapiens
EATDVIIIHSK

SEQ ID NO: 1132 - protein, 6 aa, Homo sapiens
LVVHLK

SEQ ID NO: 1133 - skipped

SEQ ID NO: 1134 - protein, 16 aa, Homo sapiens
RFSTEYELQQLEQFKK

SEQ ID NO: 1135 - protein, 11 aa, Homo sapiens
YVWIVPITSIR

SEQ ID NO: 1136 - protein, 6 aa, Homo sapiens
GFYISK

SEQ ID NO: 1137 - protein, 13 aa, Homo sapiens
KDNEETGFGSGTR

SEQ ID NO: 1138 - protein, 967 aa, Homo sapiens
MAKGFYISKSLGILGILLGVAAVCTIIALSVVYSQEKNKNANSSPVASTTPSASATTNPASATTLDQSKAWNRYRLPNTLKPDSYRVTLRPYLTPNDRGLYVFKGSSTVRFTCKEATDVIIIHSKKLNYTLSQGHRVVLRGVGGSQPPDIDKTELVEPTEYLVVHLKGSLVKDSQYEMDSEFEGELADDLAGFYRSEYMEGNVRKVVATTQMQAADARKSFPCFDEPAMKAEFNITLIHPKDLTALSNMLPKGPSTPLPEDPNWNVTEFHTTPKMSTYLLAFIVSEFDYVEKQASNGVLIRIWARPSAIAAGHGDYALNVTGPILNFFAGHYDTPYPLPKSDQIGLPDFNAGAMENWGLVTYRENSLLFDPLSSSSSNKERVVTVIAHELAHQWFGNLVTIEWWNDLWLNEGFASYVEYLGADYAEPTWNLKDLMVLNDVYRVMAVDALASSHPLSTPASEINTPAQISELFDAISYSKGASVLRMLSSFLSEDVFKQGLASYLHTFAYQNTIYLNLWDHLQEAVNNRSIQLPTTVRDIMNRWTLQMGFPVITVDTSTGTLSQEHFLLDPDSNVTRPSEFNYVWIVPITSIRDGRQQQDYWLIDVRAQNDLFSTSGNEWVLLNLNVTGYYRVNYDEENWRKIQTQLQRDHSAIPVINRAQIINDAFNLASAHKVPVTLALNNTLFLIEERQYMPWEAALSSLSYFKLMFDRSEVYGPMKNYLKKQVTPLFIHFRNNTNNWREIPENLMDQYSEVNAISTACSNGVPECEEMVSGLFKQWMENPNNNPIHPNLRSTVYCNAIAQGGEEEWDFAWEQFRNATLVNEADKLRAALACSKELWILNRYLSYTLNPDLIRKQDATSTIISITNNVIGQGLVWDFVQSNWKKLFNDYGGGSFSFSNLIQAVTRRFSTEYELQQLEQFKKDNEETGFGSGTRALEQALEKTKANIKWVKENKEVVLQWFTENSK

SEQ ID NO: 1139 - protein, 19 aa, Homo sapiens
KPDAYTEQLHNEEENEDAR

SEQ ID NO: 1140 - protein, 183 aa, Homo sapiens
MKLLSLVAVVGCLLVPPAEANKSSEDIRCKCICPPYRNISGHIYNQNVSQKDCNCLHVVEPMPVPGHDVEAYCLLCECRYEERSTTTIKVIIVIYLSVVGALLLYMAFLMLVDPLIRKPDAYTEQLHNEEENEDARSMAAAAASLGGPRANTVLERVEGAQQRWKLQVQEQRKTVFDRHKMLS

SEQ ID NO: 1141 - protein, 15 aa, Homo sapiens
AIQDMFPNMDQEVIR

SEQ ID NO: 1142 - protein, 14 aa, Homo sapiens
GPVYIGELPQDFLR

SEQ ID NO: 1143 - protein, 10 aa, Homo sapiens
IGELPQDFLR

SEQ ID NO: 1144 - protein, 274 aa, Homo sapiens
MATTVSTQRGPVYIGELPQDFLRITPTQQQRQVQLDAQAAQQLQYGGAVGTVGRLNITVVQAKLAKNYGMTRMDPYCRLRLGYAVYETPTAHNGAKNPRWNKVIHCTVPPGVDSFYLEIFDERAFSMDDRIAWTHITIPESLRQGKVEDKWYSLSGRQGDDKEGMINLVMSYALLPAAMVMPPQPVVLMPTVYQQGVGYVPITGMPAVCSPGMVPVALPPAAVNAQPRCSEEDLKAIQDMFPNMDQEVIRSVLEAQRGNKDAAINSLLQMGEEP

SEQ ID NO: 1145 - protein, 11 aa, Homo sapiens
ILDAIDDFGLR

SEQ ID NO: 1146 - protein, 24 aa, Homo sapiens
EPTSLMDILPTVASVSGGSLPQDR

SEQ ID NO: 1147 - protein, 590 aa, Homo sapiens
MRPRRPLVFMSLVCALLNTCQAHRVHDDKPNIVLIMVDDLGIGDLGCYGNDTMRTPHIDRLAREGVRLTQHISAASLCSPSRSAFLTGRYPIRSGMVSSGNRRVIQNLAVPAGLPLNETTLAALLKKQGYSTGLIGKWHQGLNCDSRSDQCHHPYNYGFDYYYGMPFTLVDSCWPDPSRNTELAFESQLWLCVQLVAIAILTLTFGKLSGWVSVPWLLIFSMILFIFLLGYAWFSSHTSPLYWDCLLMRGHEITEQPMKAERAGSIMVKEAISFLERHSKETFLLFFSFLHVHTPLPTTDDFTGTSKHGLYGDNVEEMDSMVGKILDAIDDFGLRNNTLVYFTSDHGGHLEARRGHAQLGGWNGIYKGGKGMGGWEGGIRVPGIVRWPGKVPAGRLIKEPTSLMDILPTVASVSGGSLPQDRVIDGRDLMPLLQGNVRHSEHEFLFHYCGSYLHAVRWIPKDDSGSVWKAHYVTPVFQPPASGGCYVTSLCRCFGEQVTYHNPPLLFDLSRDPSESTPLTPATEPLHDFVIKKVANALKEHQETIVPVTYQLSELNQGRTWLKPCCGVFPFCLCDKEEEVSQPRGPNEKR

SEQ ID NO: 1148 - protein, 13 aa, Homo sapiens
LLSAEFLEQHYDR

SEQ ID NO: 1149 - protein, 16 aa, Homo sapiens
LVSLPFGIATNQDLIR

SEQ ID NO: 1150 - protein, 5635 aa, Homo sapiens
MISWEVVHTVFLFALLYSSLAQDASPQSEIRAEEIPEGASTLAFVFDVTGSMYDDLVQVIEGASKILETSLKRPKRPLFNFALVPFHDPEIGPVTITTDPKKFQYELRELYVQGGGDCPEMSIGAIKIALEISLPGSFIYVFTDARSKDYRLTHEVLQLIQQKQSQVVFVLTGDCDDRTHIGYKVYEEIASTSSGQVFHLDKKQVNEVLKWVEEAVQASKVHLLSTDHLEQAVNTWRIPFDPSLKEVTVSLSGPSPMIEIRNPLGKLIKKGFGLHELLNIHNSAKVVNVKEPEAGMWTVKTSSSGRHSVRITGLSTIDFRAGFSRKPTLDFKKTVSRPVQGIPTYVLLNTSGISTPARIDLLELLSISGSSLKTIPVKYYPHRKPYGIWNISDFVPPNEAFFLKVTGYDKDDYLFQRVSSVSFSSIVPDAPKVTMPEKTPGYYLQPGQIPCSVDSLLPFTLSFVRNGVTLGVDQYLKESASVNLDIAKVTLSDEGFYECIAVSSAGTGRAQTFFDVSEPPPVIQVPNNVTVTPGERAVLTCLIISAVDYNLTWQRNDRDVRLAEPARIRTLANLSLELKSVKFNDAGEYHCMVSSEGGSSAASVFLTVQEPPKVTVMPKNQSFTGGSEVSIMCSATGYPKPKIAWTVNDMFIVGSHRYRMTSDGTLFIKNAAPKDAGIYGCLASNSAGTDKQNSTLRYIEAPKLMVVQSELLVALGDITVMECKTSGIPPPQVKWFKGDLELRPSTFLIIDPLLGLLKIQETQDLDAGDYTCVAINEAGRATGKITLDVGSPPVFIQEPADVSMEIGSNVTLPCYVQGYPEPTIKWRRLDNMPIFSRPFSVSSISQLRTGALFILNLWASDKGTYICEAENQFGKIQSETTVTVTGLVAPLIGISPSVANVIEGQQLTLPCTLLAGNPIPERRWIKNSAMLLQNPYITVRSDGSLHIERVQLQDGGEYTCVASNVAGTNNKTTSVVVHVLPTIQHGQQILSTIEGIPVTLPCKASGNPKPSVIWSKKGELISTSSAKFSAGADGSLYVVSPGGEESGEYVCTATNTAGYAKRKVQLTVYVRPRVFGDQRGLSQDKPVEISVLAGEEVTLPCEVKSLPPPIITWAKETQLISPFSPRHTFLPSGSMKITETRTSDSGMYLCVATNIAGNVTQAVKLNVHVPPKIQRGPKHLKVQVGQRVDIPCNAQGTPLPVITWSKGGSTMLVDGEHHVSNPDGTLSIDQATPSDAGIYTCVATNIAGTDETEITLHVQEPPTVEDLEPPYNTTFQERVANQRIEFPCPAKGTPKPTIKWLHNGRELTGREPGISILEDGTLLVIASVTPYDNGEYICVAVNEAGTTERKYNLKVHVPPVIKDKEQVTNVSVLLNQLTNLFCEVEGTPSPIIMWYKDNVQVTESSTIQTVNNGKILKLFRATPEDAGRYSCKAINIAGTSQKYFNIDVLVPPTIIGTNFPNEVSVVLNRDVALECQVKGTPFPDIHWFKDGKPLFLGDPNVELLDRGQVLHLKNARRNDKGRYQCTVSNAAGKQAKDIKLTIYIPPSIKGGNVTTDISVLINSLIKLECETRGLPMPAITWYKDGQPIMSSSQALYIDKGQYLHIPRAQVSDSATYTCHVANVAGTAEKSFHVDVYVPPMIEGNLATPLNKQVVIAHSLTLECKAAGNPSPILTWLKDGVPVKANDNIRIEAGGKKLEIMSAQEIDRGQYICVATSVAGEKEIKYEVDVLVPPAIEGGDETSYFIVMVNNLLELDCHVTGSPPPTIMWLKDGQLIDERDGFKILLNGRKLVIAQAQVSNTGLYRCMAANTAGDHKKEFEVTVHVPPTIKSSGLSERVVVKYKPVALQCIANGIPNPSITWLKDDQPVNTAQGNLKIQSSGRVLQIAKTLLEDAGRYTCVATNAAGETQQHIQLHVHEPPSLEDAGKMLNETVLVSNPVQLECKAAGNPVPVITWYKDNRLLSGSTSMTFLNRGQIIDIESAQISDAGIYKCVAINSAGATELFYSLQVHVAPSISGSNNMVAVVVNNPVRLECEARGIPAPSLTWLKDGSPVSSFSNGLQVLSGGRILALTSAQISDTGRYTCVAVNAAGEKQRDIDLRVYVPPNIMGEEQNVSVLISQAVELLCQSDAIPPPTLTWLKDGHPLLKKPGLSISENRSVLKIEDAQVQDTGRYTCEATNVAGKTEKNYNVNIWVPPNIGGSDELTQLTVIEGNLISLLCESSGIPPPNLIWKKKGSPVLTDSMGRVRILSGGRQLQISIAEKSDAALYSCVASNVAGTAKKEYNLQVYIRPTITNSGSHPTEIIVTRGKSISLECEVQGIPPPTVTWMKDGHPLIKAKGVEILDEGHILQLKNIHVSDTGRYVCVAVNVAGMTDKKYDLSVHAPPSIIGNHRSPENISVVEKNSVSLTCEASGIPLPSITWFKDGWPVSLSNSVRILSGGRMLRLMQTTMEDAGQYTCVVRNAAGEERKIFGLSVLVPPHIVGENTLEDVKVKEKQSVTLTCEVTGNPVPEITWHKDGQPLQEDEAHHIISGGRFLQITNVQVPHTGRYTCLASSPAGHKSRSFSLNVFVSPTIAGVGSDGNPEDVTVILNSPTSLVCEAYSYPPATITWFKDGTPLESNRNIRILPGGRTLQILNAQEDNAGRYSCVATNEAGEMIKHYEVKVYIPPIINKGDLWGPGLSPKEVKIKVNNTLTLECEAYAIPSASLSWYKDGQPLKSDDHVNIAANGHTLQIKEAQISDTGRYTCVASNIAGEDELDFDVNIQVPPSFQKLWEIGNMLDTGRNGEAKDVIINNPISLYCETNAAPPPTLTWYKDGHPLTSSDKVLILPGGRVLQIPRAKVEDAGRYTCVAVNEAGEDSLQYDVRVLVPPIIKGANSDLPEEVTVLVNKSALIECLSSGSPAPRNSWQKDGQPLLEDDHHKFLSNGRILQILNTQITDIGRYVCVAENTAGSAKKYFNLNVHVPPSVIGPKSENLTVVVNNFISLTCEVSGFPPPDLSWLKNEQPIKLNTNTLIVPGGRTLQIIRAKVSDGGEYTCIAINQAGESKKKFSLTVYVPPSIKDHDSESLSVVNVREGTSVSLECESNAVPPPVITWYKNGRMITESTHVEILADGQMLHIKKAEVSDTGQYVCRAINVAGRDDKNFHLNVYVPPSIEGPEREVIVETISNPVTLTCDATGIPPPTIAWLKNHKRIENSDSLEVRILSGGSKLQIARSQHSDSGNYTCIASNMEGKAQKYYFLSIQVPPSVAGAEIPSDVSVLLGENVELVCNANGIPTPLIQWLKDGKPIASGETERIRVSANGSTLNIYGALTSDTGKYTCVATNPAGEEDRIFNLNVYVTPTIRGNKDEAEKLMTLVDTSINIECRATGTPPPQINWLKNGLPLPLSSHIRLLAAGQVIRIVRAQVSDVAVYTCVASNRAGVDNKHYNLQVFAPPNMDNSMGTEEITVLKGSSTSMACITDGTPAPSMAWLRDGQPLGLDAHLTVSTHGMVLQLLKAETEDSGKYTCIASNEAGEVSKHFILKVLEPPHINGSEEHEEISVIVNNPLELTCIASGIPAPKMTWMKDGRPLPQTDQVQTLGGGEVLRISTAQVEDTGRYTCLASSPAGDDDKEYLVRVHVPPNIAGTDEPRDITVLRNRQVTLECKSDAVPPPVITWLRNGERLQATPRVRILSGGRYLQINNADLGDTANYTCVASNIAGKTTREFILTVNVPPNIKGGPQSLVILLNKSTVLECIAEGVPTPRITWRKDGAVLAGNHARYSILENGFLHIQSAHVTDTGRYLCMATNAAGTDRRRIDLQVHVPPSIAPGPTNMTVIVNVQTTLACEATGIPKPSINWRKNGHLLNVDQNQNSYRLLSSGSLVIISPSVDDTATYECTVTNGAGDDKRTVDLTVQVPPSIADEPTDFLVTKHAPAVITCTASGVPFPSIHWTKNGIRLLPRGDGYRILSSGAIEILATQLNHAGRYTCVARNAAGSAHRHVTLHVHEPPVIQPQPSELHVILNNPILLPCEATGTPSPFITWQKEGINVNTSGRNHAVLPSGGLQISRAVREDAGTYMCVAQNPAGTALGKIKLNVQVPPVISPHLKEYVIAVDKPITLSCEADGLPPPDITWHKDGRAIVESIRQRVLSSGSLQIAFVQPGDAGHYTCMAANVAGSSSTSTKLTVHVPPRIRSTEGHYTVNENSQAILPCVADGIPTPAINWKKDNVLLANLLGKYTAEPYGELILENVVLEDSGFYTCVANNAAGEDTHTVSLTVHVLPTFTELPGDVSLNKGEQLRLSCKATGIPLPKLTWTFNNNIIPAHFDSVNGHSELVIERVSKEDSGTYVCTAENSVGFVKAIGFVYVKEPPVFKGDYPSNWIEPLGGNAILNCEVKGDPTPTIQWNRKGVDIEISHRIRQLGNGSLAIYGTVNEDAGDYTCVATNEAGVVERSMSLTLQSPPIITLEPVETVINAGGKIILNCQATGEPQPTITWSRQGHSISWDDRVNVLSNNSLYIADAQKEDTSEFECVARNLMGSVLVRVPVIVQVHGGFSQWSAWRACSVTCGKGIQKRSRLCNQPLPANGGKPCQGSDLEMRNCQNKPCPVDGSWSEWSLWEECTRSCGRGNQTRTRTCNNPSVQHGGRPCEGNAVEIIMCNIRPCPVHGAWSAWQPWGTCSESCGKGTQTRARLCNNPPPAFGGSYCDGAETQMQVCNERNCPIHGKWATWASWSACSVSCGGGARQRTRGCSDPVPQYGGRKCEGSDVQSDFCNSDPCPTHGNWSPWSGWGTCSRTCNGGQMRRYRTCDNPPPSNGGRACGGPDSQIQRCNTDMCPVDGSWGSWHSWSQCSASCGGGEKTRKRLCDHPVPVKGGRPCPGDTTQVTRCNVQACPGGPQRARGSVIGNINDVEFGIAFLNATITDSPNSDTRIIRAKITNVPRSLGSAMRKIVSILNPIYWTTAKEIGEAVNGFTLTNAVFKRETQVEFATGEILQMSHIARGLDSDGSLLLDIVVSGYVLQLQSPAEVTVKDYTEDYIQTGPGQLYAYSTRLFTIDGISIPYTWNHTVFYDQAQGRMPFLVETLHASSVESDYNQIEETLGFKIHASISKGDRSNQCPSGFTLDSVGPFCADEDECAAGNPCSHSCHNAMGTYYCSCPKGLTIAADGRTCQDIDECALGRHTCHAGQDCDNTIGSYRCVVRCGSGFRRTSDGLSCQDINECQESSPCHQRCFNAIGSFHCGCEPGYQLKGRKCMDVNECRQNVCRPDQHCKNTRGGYKCIDLCPNGMTKAENGTCIDIDECKDGTHQCRYNQICENTRGSYRCVCPRGYRSQGVGRPCMDINECEQVPKPCAHQCSNTPGSFKCICPPGQHLLGDGKSCAGLERLPNYGTQYSSYNLARFSPVRNNYQPQQHYRQYSHLYSSYSEYRNSRTSLSRTRRTIRKTCPEGSEASHDTCVDIDECENTDACQHECKNTFGSYQCICPPGYQLTHNGKTCQDIDECLEQNVHCGPNRMCFNMRGSYQCIDTPCPPNYQRDPVSGFCLKNCPPNDLECALSPYALEYKLVSLPFGIATNQDLIRLVAYTQDGVMHPRTTFLMVDEEQTVPFALRDENLKGVVYTTRPLREAETYRMRVRASSYSANGTIEYQTTFIVYIAVSAYPY

SEQ ID NO: 1151 - protein, 10 aa, Homo sapiens
AVGLLTVISK

SEQ ID NO: 1152 - protein, 123 aa, Homo sapiens
MKAVLLALLMAGLALQPGTALLCYSCKAQVSNEDCLQVENCTQLGEQCWTARIRAVGLLTVISKGCSLNCVDDSQDYYVGKKNITCCDTDLCNASGAHALQPAAAILALLPALGLLLWGPGQL

SEQ ID NO: 1153 - protein, 14 aa, Homo sapiens
QEEPLPEHPQDGAK

SEQ ID NO: 1154 - protein, 570 aa, Homo sapiens
MEAPEEPAPVRGGPEATLEVRGSRCLRLSAFREELRALLVLAGPAFLVQLMVFLISFISSVFCGHLGKLELDAVTLAIAVINVTGVSVGFGLSSACDTLISQTYGSQNLKHVGVILQRSALVLLLCCFPCWALFLNTQHILLLFRQDPDVSRLTQTYVTIFIPALPATFLYMLQVKYLLNQGIVLPQIVTGVAANLVNALANYLFLHQLHLGVIGSALANLISQYTLALLLFLYILGKKLHQATWGGWSLECLQDWASFLRLAIPSMLMLCMEWWAYEVGSFLSGILGMVELGAQSIVYELAIIVYMVPAGFSVAASVRVGNALGAGDMEQARKSSTVSLLITVLFAVAFSVLLLSCKDHVGYIFTTDRDIINLVAQVVPIYAVSHLFEALACTSGGVLRGSGNQKVGAIVNTIGYYVVGLPIGIALMFATTLGVMGLWSGIIICTVFQAVCFLGFIIQLNWKKACQQAQVHANLKVNNVPRSGNSALPQDPLHPGCPENLEGILTNDVGKTGEPQSDQQMRQEEPLPEHPQDGAKLSRKQLVLRRGLLLLGVFLILLVGILVRFYVRIQ

SEQ ID NO: 1155 - protein, 12 aa, Homo sapiens
DGSFSVVITGLR

SEQ ID NO: 1156 - protein, 20 aa, Homo sapiens
ILLNPQDKDGSFSVVITGLR

SEQ ID NO: 1157 - protein, 19 aa, Homo sapiens
LDIQGTGQLLFSVVINQLR

SEQ ID NO: 1158 - protein, 11 aa, Homo sapiens
LVSLTLNLVTR

SEQ ID NO: 1159 - protein, 19 aa, Homo sapiens
NADLQVLKPEPELVYEDLR

SEQ ID NO: 1160 - protein, 12 aa, Homo sapiens
QLFVNEESTIPR

SEQ ID NO: 1161 - protein, 16 aa, Homo sapiens
QSSGENCDVVVNTLGK

SEQ ID NO: 1162 - protein, 9 aa, Homo sapiens
TVTINCPFK

SEQ ID NO: 1163 - protein, 14 aa, Homo sapiens
VVNIAQLSQDDSGR

SEQ ID NO: 1164 - protein, 20 aa, Homo sapiens
YLCGAHSDGQLQEGSPIQAW

SEQ ID NO: 1165 - protein, 12 aa, Homo sapiens
YWCLWEGAQNGR

SEQ ID NO: 1166 - protein, 8 aa, Homo sapiens
SVVINQLR

SEQ ID NO: 1167 - protein, 7 aa, Homo sapiens
KTENAQK

SEQ ID NO: 1168 - protein, 13 aa, Homo sapiens
HCALGPEVANVAK

SEQ ID NO: 1169 - protein, 8 aa, Homo sapiens
ILLNPQDK

SEQ ID NO: 1170 - protein, 8 aa, Homo sapiens
ADAAPDEK

SEQ ID NO: 1171 - protein, 764 aa, Homo sapiens
MLLFVLTCLLAVFPAISTKSPIFGPEEVNSVEGNSVSITCYYPPTSVNRHTRKYWCRQGARGGCITLISSEGYVSSKYAGRANLTNFPENGTFVVNIAQLSQDDSGRYKCGLGINSRGLSFDVSLEVSQGPGLLNDTKVYTVDLGRTVTINCPFKTENAQKRKSLYKQIGLYPVLVIDSSGYVNPNYTGRIRLDIQGTGQLLFSVVINQLRLSDAGQYLCQAGDDSNSNKKNADLQVLKPEPELVYEDLRGSVTFHCALGPEVANVAKFLCRQSSGENCDVVVNTLGKRAPAFEGRILLNPQDKDGSFSVVITGLRKEDAGRYLCGAHSDGQLQEGSPIQAWQLFVNEESTIPRSPTVVKGVAGGSVAVLCPYNRKESKSIKYWCLWEGAQNGRCPLLVDSEGWVKAQYEGRLSLLEEPGNGTFTVILNQLTSRDAGFYWCLTNGDTLWRTTVEIKIIEGEPNLKVPGNVTAVLGETLKVPCHFPCKFSSYEKYWCKWNNTGCQALPSQDEGPSKAFVNCDENSRLVSLTLNLVTRADEGWYWCGVKQGHFYGETAAVYVAVEERKAAGSRDVSLAKADAAPDEKVLDSGFREIENKAIQDPRLFAEEKAVADTRDQADGSRASVDSGSSEEQGGSSRALVSTLVPLGLVLAVGAVAVGVARARHRKNVDRVSIRSYRTDISMSDFENSREFGANDNMGASSITQETSLGGKEEFVATTESTTETKEPKKAKRSSKEEAEMAYKDFLLQSSTVAAEAQDGPQEA

SEQ ID NO: 1172 - protein, 14 aa, Homo sapiens
AVAFEVYDDFLHYK

SEQ ID NO: 1173 - protein, 10 aa, Homo sapiens
EVYDDFLHYK

SEQ ID NO: 1174 - protein, 19 aa, Homo sapiens
GTDECAIESIAVAATPIPK

SEQ ID NO: 1175 - protein, 12 aa, Homo sapiens
NVHGINFVSPVR

SEQ ID NO: 1176 - protein, 6 aa, Homo sapiens
WFAFFK

SEQ ID NO: 1177 - protein, 13 aa, Homo sapiens
LELVHHGPMAVAF

SEQ ID NO: 1178 - protein, 15 aa, Homo sapiens
TVAGQDAVIVLLGTR

SEQ ID NO: 1179 - protein, 206 aa, Homo sapiens
MAVKKIAIFGATGQTGLTTLAQAVQAGYEVTVLVRDSSRLPSEGPRPAHVVVGDVLQAADVDKTVAGQDAVIVLLGTRNDLSPTTVMSEGARNIVAAMKAHGVDKVVACTSAFLLWDPTKVPPRLQAVTDDHIRMHKVLRESGLKYVAVMPPHIGDQPLTGAYTVTLDGRGPSRVISKHDLGHFMLRCLTTDEYDGHSTYPSHQYQ

SEQ ID NO: 1180 - protein, 14 aa, Homo sapiens
LYTLVLTDPDAPSR

SEQ ID NO: 1181 - protein, 13 aa, Homo sapiens
YVWLVYEQDRPLK

SEQ ID NO: 1182 - protein, 187 aa, Homo sapiens
MPVDLSKWSGPLSLQEVDEQPQHPLHVTYAGAAVDELGKVLTPTQVKNRPTSISWDGLDSGKLYTLVLTDPDAPSRKDPKYREWHHFLVVNMKGNDISSGTVLSDYVGSGPPKGTGLHRYVWLVYEQDRPLKCDEPILSNRSGDHRGKFKVASFRKKYELRAPVAGTCYQAEWDDYVPKLYEQLSGK

SEQ ID NO: 1183 - protein, 10 aa, Homo sapiens
LLDEVFFSEK

SEQ ID NO: 1184 - protein, 14 aa, Homo sapiens
LQVNTPLVGASLLR

SEQ ID NO: 1185 - protein, 11 aa, Homo sapiens
IYIPLPEEAAR

SEQ ID NO: 1186 - protein, 20 aa, Homo sapiens
LHLGSTPHNLTDANIHELAR

SEQ ID NO: 1187 - protein, 19 aa, Homo sapiens
QHKPSIIFIDEVDSLCGSR

SEQ ID NO: 1188 - protein, 13 aa, Homo sapiens
LLEPVVCMSDMLR

SEQ ID NO: 1189 - protein, 437 aa, Homo sapiens
MTTSTLQKAIDLVTKATEEDKAKNYEEALRLYQHAVEYFLHAIKYEAHSDKAKESIRAKCVQYLDRAEKLKDYLRSKEKHGKKPVKENQSEGKGSDSDSEGDNPEKKKLQEQLMGAVVMEKPNIRWNDVAGLEGAKEALKEAVILPIKFPHLFTGKRTPWRGILLFGPPGTGKSYLAKAVATEANNSTFFSVSSSDLMSKWLGESEKLVKNLFELARQHKPSIIFIDEVDSLCGSRNENESEAARRIKTEFLVQMQGVGNNNDGTLVLGATNIPWVLDSAIRRRFEKRIYIPLPEEAARAQMFRLHLGSTPHNLTDANIHELARKTEGYSGADISIIVRDSLMQPVRKVQSATHFKKVCGPSRTNPSMMIDDLLTPCSPGDPGAMEMTWMDVPGDKLLEPVVCMSDMLRSLATTRPTVNADDLLKVKKFSEDFGQES

SEQ ID NO: 1190 - protein, 15 aa, Homo sapiens
IYAYPSNITSETGFR

SEQ ID NO: 1191 - protein, 12 aa, Homo sapiens
AKPEPDILEEEK

SEQ ID NO: 1192 - protein, 271 aa, Homo sapiens
MAAGGRMEDGSLDITQSIEDDPLLDAQLLPHHSLQAHFRPRFHPLPTVIIVNLLWFIHLVFVVLAFLTGVLCSYPNPNEDKCPGNYTNPLKVQTVIILGKVILWILHLLLECYIQYHHSKIRNRGYNLIYRSTRHLKRLALMIQSSGNTVLLLILCMQHSFPEPGRLYLDLILAILALELICSLICLLIYTVKIRRFNKAKPEPDILEEEKIYAYPSNITSETGFRTISSLEEIVEKQGDTIEYLKRHNALLSKRLLALTSSDLGCQPSRT

SEQ ID NO: 1193 - protein, 15 aa, Homo sapiens
DVWGIEGPIDAAFTR

SEQ ID NO: 1194 - protein, 16 aa, Homo sapiens
DWHGVPGQVDAAMAGR

SEQ ID NO: 1195 - protein, 12 aa, Homo sapiens
FEDGVLDPDYPR

SEQ ID NO: 1196 - protein, 478 aa, Homo sapiens
MAPLRPLLILALLAWVALADQESCKGRCTEGFNVDKKCQCDELCSYYQSCCTDYTAECKPQVTRGDVFTMPEDEYTVYDDGEEKNNATVHEQVGGPSLTSDLQAQSKGNPEQTPVLKPEEEAPAPEVGASKPEGIDSRPETLHPGRPQPPAEEELCSGKPFDAFTDLKNGSLFAFRGQYCYELDEKAVRPGYPKLIRDVWGIEGPIDAAFTRINCQGKTYLFKGSQYWRFEDGVLDPDYPRNISDGFDGIPDNVDAALALPAHSYSGRERVYFFKGKQYWEYQFQHQPSQEECEGSSLSAVFEHFAMMQRDSWEDIFELLFWGRTSAGTRQPQFISRDWHGVPGQVDAAMAGRIYISGMAPRPSLAKKQRFRHRNRKGYRSQRGHSRGRNQNSRRPSRATWLSLFSSEESNLGANNYDDYRMDWLVPATCEPIQSVFFFSGDKYYRVNLRTRRVDTVDPPYPRSIAQYWLGCPAPGHL

SEQ ID NO: 1197 - protein, 14 aa, Homo sapiens
AFVLSSVDELEQQR

SEQ ID NO: 1198 - protein, 13 aa, Homo sapiens
APILIQDFETLPR

SEQ ID NO: 1199 - protein, 22 aa, Homo sapiens
AVVILVTDVSVDSVDAAADAAR

SEQ ID NO: 1200 - protein, 13 aa, Homo sapiens
LLDLVFLLDGSSR

SEQ ID NO: 1201 - protein, 23 aa, Homo sapiens
LPGDIQVVPIGVGPNANVQELER

SEQ ID NO: 1202 - protein, 15 aa, Homo sapiens
VIVIPVGIGPHANLK

SEQ ID NO: 1203 - protein, 9 aa, Homo sapiens
EAPDLVLQR

SEQ ID NO: 1204 - protein, 2813 aa, Homo sapiens
MIPARFAGVLLALALILPGTLCAEGTRGRSSTARCSLFGSDFVNTFDGSMYSFAGYCSYLLAGGCQKRSFSIIGDFQNGKRVSLSVYLGEFFDIHLFVNGTVTQGDQRVSMPYASKGLYLETEAGYYKLSGEAYGFVARIDGSGNFQVLLSDRYFNKTCGLCGNFNIFAEDDFMTQEGTLTSDPYDFANSWALSSGEQWCERASPPSSSCNISSGEMQKGLWEQCQLLKSTSVFARCHPLVDPEPFVALCEKTLCECAGGLECACPALLEYARTCAQEGMVLYGWTDHSACSPVCPAGMEYRQCVSPCARTCQSLHINEMCQERCVDGCSCPEGQLLDEGLCVESTECPCVHSGKRYPPGTSLSRDCNTCICRNSQWICSNEECPGECLVTGQSHFKSFDNRYFTFSGICQYLLARDCQDHSFSIVIETVQCADDRDAVCTRSVTVRLPGLHNSLVKLKHGAGVAMDGQDVQLPLLKGDLRIQHTVTASVRLSYGEDLQMDWDGRGRLLVKLSPVYAGKTCGLCGNYNGNQGDDFLTPSGLAEPRVEDFGNAWKLHGDCQDLQKQHSDPCALNPRMTRFSEEACAVLTSPTFEACHRAVSPLPYLRNCRYDVCSCSDGRECLCGALASYAAACAGRGVRVAWREPGRCELNCPKGQVYLQCGTPCNLTCRSLSYPDEECNEACLEGCFCPPGLYMDERGDCVPKAQCPCYYDGEIFQPEDIFSDHHTMCYCEDGFMHCTMSGVPGSLLPDAVLSSPLSHRSKRSLSCRPPMVKLVCPADNLRAEGLECTKTCQNYDLECMSMGCVSGCLCPPGMVRHENRCVALERCPCFHQGKEYAPGETVKIGCNTCVCRDRKWNCTDHVCDATCSTIGMAHYLTFDGLKYLFPGECQYVLVQDYCGSNPGTFRILVGNKGCSHPSVKCKKRVTILVEGGEIELFDGEVNVKRPMKDETHFEVVESGRYIILLLGKALSVVWDRHLSISVVLKQTYQEKVCGLCGNFDGIQNNDLTSSNLQVEEDPVDFGNSWKVSSQCADTRKVPLDSSPATCHNNIMKQTMVDSSCRILTSDVFQDCNKLVDPEPYLDVCIYDTCSCESIGDCACFCDTIAAYAHVCAQHGKVVTWRTATLCPQSCEERNLRENGYECEWRYNSCAPACQVTCQHPEPLACPVQCVEGCHAHCPPGKILDELLQTCVDPEDCPVCEVAGRRFASGKKVTLNPSDPEHCQICHCDVVNLTCEACQEPGGLVVPPTDAPVSPTTLYVEDISEPPLHDFYCSRLLDLVFLLDGSSRLSEAEFEVLKAFVVDMMERLRISQKWVRVAVVEYHDGSHAYIGLKDRKRPSELRRIASQVKYAGSQVASTSEVLKYTLFQIFSKIDRPEASRITLLLMASQEPQRMSRNFVRYVQGLKKKKVIVIPVGIGPHANLKQIRLIEKQAPENKAFVLSSVDELEQQRDEIVSYLCDLAPEAPPPTLPPDMAQVTVGPGLLGVSTLGPKRNSMVLDVAFVLEGSDKIGEADFNRSKEFMEEVIQRMDVGQDSIHVTVLQYSYMVTVEYPFSEAQSKGDILQRVREIRYQGGNRTNTGLALRYLSDHSFLVSQGDREQAPNLVYMVTGNPASDEIKRLPGDIQVVPIGVGPNANVQELERIGWPNAPILIQDFETLPREAPDLVLQRCCSGEGLQIPTLSPAPDCSQPLDVILLLDGSSSFPASYFDEMKSFAKAFISKANIGPRLTQVSVLQYGSITTIDVPWNVVPEKAHLLSLVDVMQREGGPSQIGDALGFAVRYLTSEMHGARPGASKAVVILVTDVSVDSVDAAADAARSNRVTVFPIGIGDRYDAAQLRILAGPAGDSNVVKLQRIEDLPTMVTLGNSFLHKLCSGFVRICMDEDGNEKRPGDVWTLPDQCHTVTCQPDGQTLLKSHRVNCDRGLRPSCPNSQSPVKVEETCGCRWTCPCVCTGSSTRHIVTFDGQNFKLTGSCSYVLFQNKEQDLEVILHNGACSPGARQGCMKSIEVKHSALSVELHSDMEVTVNGRLVSVPYVGGNMEVNVYGAIMHEVRFNHLGHIFTFTPQNNEFQLQLSPKTFASKTYGLCGICDENGANDFMLRDGTVTTDWKTLVQEWTVQRPGQTCQPILEEQCLVPDSSHCQVLLLPLFAECHKVLAPATFYAICQQDSCHQEQVCEVIASYAHLCRTNGVCVDWRTPDFCAMSCPPSLVYNHCEHGCPRHCDGNVSSCGDHPSEGCFCPPDKVMLEGSCVPEEACTQCIGEDGVQHQFLEAWVPDHQPCQICTCLSGRKVNCTTQPCPTAKAPTCGLCEVARLRQNADQCCPEYECVCDPVSCDLPPVPHCERGLQPTLTNPGECRPNFTCACRKEECKRVSPPSCPPHRLPTLRKTQCCDEYECACNCVNSTVSCPLGYLASTATNDCGCTTTTCLPDKVCVHRSTIYPVGQFWEEGCDVCTCTDMEDAVMGLRVAQCSQKPCEDSCRSGFTYVLHEGECCGRCLPSACEVVTGSPRGDSQSSWKSVGSQWASPENPCLINECVRVKEEVFIQQRNVSCPQLEVPVCPSGFQLSCKTSACCPSCRCERMEACMLNGTVIGPGKTVMIDVCTTCRCMVQVGVISGFKLECRKTTCNPCPLGYKEENNTGECCGRCLPTACTIQLRGGQIMTLKRDETLQDGCDTHFCKVNERGEYFWEKRVTGCPPFDEHKCLAEGGKIMKIPGTCCDTCEEPECNDITARLQYVKVGSCKSEVEVDIHYCQGKCASKAMYSIDINDVQDQCSCCSPTRTEPMQVALHCTNGSVVYHEVLNAMECKCSPRKCSK

SEQ ID NO: 1205 - protein, 17 aa, Homo sapiens
GLVEAVESTLQTPLDIR

SEQ ID NO: 1206 - protein, 12 aa, Homo sapiens
ATFQEPLYPALR

SEQ ID NO: 1207 - protein, 18 aa, Homo sapiens
DIQMTQSPSSLSASVGDR

SEQ ID NO: 1208 - protein, 16 aa, Homo sapiens
YPIEHGIITNWDDMEK

SEQ ID NO: 1209 - protein, 377 aa, Homo sapiens
MCDEDETTALVCDNGSGLVKAGFAGDDAPRAVFPSIVGRPRHQGVMVGMGQKDSYVGDEAQSKRGILTLKYPIEHGIITNWDDMEKIWHHTFYNELRVAPEEHPTLLTEAPLNPKANREKMTQIMFETFNVPAMYVAIQAVLSLYASGRTTGIVLDSGDGVTHNVPIYEGYALPHAIMRLDLAGRDLTDYLMKILTERGYSFVTTAEREIVRDIKEKLCYVALDFENEMATAASSSSLEKSYELPDGQVITIGNERFRCPETLFQPSFIGMESAGIHETTYNSIMKCDIDIRKDLYANNVMSGGTTMYPGIADRMQKEITALAPSTMKIKIIAPPERKYSVWIGGSILASLSTFQQMWITKQEYDEAGPSIVHRKCF

SEQ ID NO: 1210 - protein, 12 aa, Homo sapiens
ASVDELFAEIVR

SEQ ID NO: 1211 - protein, 183 aa, Homo sapiens
MREYKVVVLGSGGVGKSALTVQFVTGSFIEKYDPTIEDFYRKEIEVDSSPSVLEILDTAGTEQFASMRDLYIKNGQGFILVYSLVNQQSFQDIKPMRDQIIRVKRYERVPMILVGNKVDLEGEREVSYGEGKALAEEWSCPFMETSAKNKASVDELFAEIVRQMNYAAQPNGDEGCCSACVIL

SEQ ID NO: 1212 - protein, 11 aa, Homo sapiens
IDDLIGDLVQR

SEQ ID NO: 1213 - protein, 10 aa, Homo sapiens
LLLVSFDGFR

SEQ ID NO: 1214 - protein, 12 aa, Homo sapiens
KIDDLIGDLVQR

SEQ ID NO: 1215 - protein, 453 aa, Homo sapiens
MKLLVILLFSGLITGFRSDSSSSLPPKLLLVSFDGFRADYLKNYEFPHLQNFIKEGVLVEHVKNVFITKTFPNHYSIVTGLYEESHGIVANSMYDAVTKKHFSDSNDKDPFWWNEAVPIWVTNQLQENRSSAAAMWPGTDVPIHDTISSYFMNYNSSVSFEERLNNITMWLNNSNPPVTFATLYWEEPDASGHKYGPEDKENMSRVLKKIDDLIGDLVQRLKMLGLWENLNVIITSDHGMTQCSQDRLINLDSCIDHSYYTLIDLSPVAAILPKINRTEVYNKLKNCSPHMNVYLKEDIPNRFYYQHNDRIQPIILVADEGWTIVLNESSQKLGDHGYDNSLPSMHPFLAAHGPAFHKGYKHSTINIVDIYPMMCHILGLKPHPNNGTFGHTKCLLVDQWCINLPEAIAIVIGSLLVLTMLTCLIIIMQNRLSVPRPFSRLQLQEDDDDPLIG

SEQ ID NO: 1216 - protein, 14 aa, Homo sapiens
AVSDSFGPGEWDDR

SEQ ID NO: 1217 - protein, 311 aa, Homo sapiens
MSNPSAPPPYEDRNPLYPGPPPPGGYGQPSVLPGGYPAYPGYPQPGYGHPAGYPQPMPPTHPMPMNYGPGHGYDGEERAVSDSFGPGEWDDRKVRHTFIRKVYSIISVQLLITVAIIAIFTFVEPVSAFVRRNVAVYYVSYAVFVVTYLILACCQGPRRRFPWNIILLTLFTFAMGFMTGTISSMYQTKAVIIAMIITAVVSISVTIFCFQTKVDFTSCTGLFCVLGIVLLVTGIVTSIVLYFQYVYWLHMLYAALGAICFTLFLAYDTQLVLGNRKHTISPEDYITGALQIYTDIIYIFTFVLQLMGDRN

SEQ ID NO: 1218 - protein, 28 aa, Homo sapiens
LLTPNPGYGTQAGPSPAPPTPPEEEDLR

SEQ ID NO: 1219 - protein, 580 aa, Homo sapiens
MTAPAGPRGSETERLLTPNPGYGTQAGPSPAPPTPPEEEDLRRRLKYFFMSPCDKFRAKGRKPCKLMLQVVKILVVTVQLILFGLSNQLAVTFREENTIAFRHLFLLGYSDGADDTFAAYTREQLYQAIFHAVDQYLALPDVSLGRYAYVRGGGDPWTNGSGLALCQRYYHRGHVDPANDTFDIDPMVVTDCIQVDPPERPPPPPSDDLTLLESSSSYKNLTLKFHKLVNVTIHFRLKTINLQSLINNEIPDCYTFSVLITFDNKAHSGRIPISLETQAHIQECKHPSVFQHGDNSFRLLFDVVVILTCSLSFLLCARSLLRGFLLQNEFVGFMWRQRGRVISLWERLEFVNGWYILLVTSDVLTISGTIMKIGIEAKNLASYDVCSILLGTSTLLVWVGVIRYLTFFHNYNILIATLRVALPSVMRFCCCVAVIYLGYCFCGWIVLGPYHVKFRSLSMVSECLFSLINGDDMFVTFAAMQAQQGRSSLVWLFSQLYLYSFISLFIYMVLSLFIALITGAYDTIKHPGGAGAEESELQAYIAQCQDSPTSGKFRRGSGSACSLLCCCGRDPSEEHSLLVN

SEQ ID NO: 1220 - protein, 11 aa, Homo sapiens
NHLLHVFDEYK

SEQ ID NO: 1221 - protein, 321 aa, Homo sapiens
MAMATKGGTVKAASGFNAMEDAQTLRKAMKGLGTDEDAIISVLAYRNTAQRQEIRTAYKSTIGRDLIDDLKSELSGNFEQVIVGMMTPTVLYDVQELRRAMKGAGTDEGCLIEILASRTPEEIRRISQTYQQQYGRSLEDDIRSDTSFMFQRVLVSLSAGGRDEGNYLDDALVRQDAQDLYEAGEKKWGTDEVKFLTVLCSRNRNHLLHVFDEYKRISQKDIEQSIKSETSGSFEDALLAIVKCMRNKSAYFAEKLYKSMKGLGTDDNTLIRVMVSRAEIDMLDIRAHFKRLYGKSLYSFIKGDTSGDYRKVLLVLCGGDD

SEQ ID NO: 1222 - protein, 18 aa, Homo sapiens
DIQLTQSPSFLSASVGDR

SEQ ID NO: 1223 - protein, 16 aa, Homo sapiens
LLIYAASTLQSGVPSR

SEQ ID NO: 1224 - protein, 20 aa, Homo sapiens
QATVGDINTERPGMLDFTGK

SEQ ID NO: 1225 - protein, 12 aa, Homo sapiens
DKVMSEFNNNFR

SEQ ID NO: 1226 - protein, 10 aa, Homo sapiens
VMSEFNNNFR

SEQ ID NO: 1227 - protein, 8 aa, Homo sapiens
QQMENYPK

SEQ ID NO: 1228 - protein, 6 aa, Homo sapiens
MQADFK

SEQ ID NO: 1229 - protein, 7 aa, Homo sapiens
GINFNEK

SEQ ID NO: 1230 - protein, 6 aa, Homo sapiens
EGCVEK

SEQ ID NO: 1231 - protein, 6 aa, Homo sapiens
IGGWLR

SEQ ID NO: 1232 - protein, 10 aa, Homo sapiens
AIHKEGCVEK

SEQ ID NO: 1233 - protein, 15 aa, Homo sapiens
AVFVDLEPTVIDEIR

SEQ ID NO: 1234 - protein, 448 aa, Homo sapiens
MRECISVHVGQAGVQMGNACWELYCLEHGIQPDGQMPSDKTIGGGDDSFTTFFCETGAGKHVPRAVFVDLEPTVIDEIRNGPYRQLFHPEQLITGKEDAANNYARGHYTIGKEIIDPVLDRIRKLSDQCTGLQGFLVFHSFGGGTGSGFTSLLMERLSVDYGKKSKLEFSIYPAPQVSTAVVEPYNSILTTHTTLEHSDCAFMVDNEAIYDICRRNLDIERPTYTNLNRLISQIVSSITASLRFDGALNVDLTEFQTNLVPYPRIHFPLATYAPVISAEKAYHEQLSVAEITNACFEPANQMVKCDPRHGKYMACCLLYRGDVVPKDVNAAIAAIKTKRSIQFVDWCPTGFKVGINYQPPTVVPGGDLAKVQRAVCMLSNTTAIAEAWARLDHKFDLMYAKRAFVHWYVGEGMEEGEFSEAREDMAALEKDYEEVGIDSYEDEDEGEE

SEQ ID NO: 1235 - protein, 10 aa, Homo sapiens
EAPEPPQPQR

SEQ ID NO: 1236 - protein, 25 aa, Homo sapiens
GLTWDAAAPPGPAPWEAPEPPQPQR

SEQ ID NO: 1237 - protein, 410 aa, Homo sapiens
MEDPSGAREPRARPRERDPGRRPHPDQGRTHDRPRDRPGDPRRKRSSDGNRRRDGDRDPERDQERDGNRDRNRDRERERERERDPDRGPRRDTHRDAGPRAGEHGVWEKPRQSRTRDGARGLTWDAAAPPGPAPWEAPEPPQPQRKGDPGRRRPESEPPSERYLPSTPRPGREEVEYYQSEAEGLLECHKCKYLCTGRGVVQIVEVVLNGMVLICIVASYFVLAGFSASFSSGGGFGNNYYSPFEGTELEQVRQLDQQYTILRSPLIYGGVAVSLGLGVLTMGVLLQGAKSRTMLSGKWLLTEAAFSLLAAVGYCTGIGVYLHVALQINSTDTCKTRERLYARKGLTWMDCQLAGTDGAAATFACLLVIMYGASVVLALRSYREQKRYKGSREQPGSYSDAPEYLWSGTL

SEQ ID NO: 1238 - protein, 10 aa, Homo sapiens
ACPEHSAPIK

SEQ ID NO: 1239 - protein, 15 aa, Homo sapiens
ALEGLGEGVTFPAMH

SEQ ID NO: 1240 - protein, 8 aa, Homo sapiens
EYILSSLR

SEQ ID NO: 1241 - protein, 9 aa, Homo sapiens
TPLLPGAPR

SEQ ID NO: 1242 - protein, 495 aa, Homo sapiens
MRSPVRDLARNDGEESTDRTPLLPGAPRAEAAPVCCSARYNLAILAFFGFFIVYALRVNLSVALVDMVDSNTTLEDNRTSKACPEHSAPIKVHHNQTGKKYQWDAETQGWILGSFFYGYIITQIPGGYVASKIGGKMLLGFGILGTAVLTLFTPIAADLGVGPLIVLRALEGLGEGVTFPAMHAMWSSWAPPLERSKLLSISYAGAQLGTVISLPLSGIICYYMNWTYVFYFFGTIGIFWFLLWIWLVSDTPQKHKRISHYEKEYILSSLRNQLSSQKSVPWVPILKSLPLWAIVVAHFSYNWTFYTLLTLLPTYMKEILRFNVQENGFLSSLPYLGSWLCMILSGQAADNLRAKWNFSTLCVRRIFSLIGMIGPAVFLVAAGFIGCDYSLAVAFLTISTTLGGFCSSGFSINHLDIAPSYAGILLGITNTFATIPGMVGPVIAKSLTPDNTVGEWQTVFYIAAAINVFGAIFFTLFAKGEVQNWALNDHHGHRH

SEQ ID NO: 1243 - protein, 11 aa, Homo sapiens
EVLDSFLDLAR

SEQ ID NO: 1244 - protein, 541 aa, Homo sapiens
MVADPPRDSKGLAAAEPTANGGLALASIEDQGAAAGGYCGSRDQVRRCLRANLLVLLTVVAVVAGVALGLGVSGAGGALALGPERLSAFVFPGELLLRLLRMIILPLVVCSLIGGAASLDPGALGRLGAWALLFFLVTTLLASALGVGLALALQPGAASAAINASVGAAGSAENAPSKEVLDSFLDLARNIFPSNLVSAAFRSYSTTYEERNITGTRVKVPVGQEVEGMNILGLVVFAIVFGVALRKLGPEGELLIRFFNSFNEATMVLVSWIMWYAPVGIMFLVAGKIVEMEDVGLLFARLGKYILCCLLGHAIHGLLVLPLIYFLFTRKNPYRFLWGIVTPLATAFGTSSSSATLPLMMKCVEENNGVAKHISRFILPIGATVNMDGAALFQCVAAVFIAQLSQQSLDFVKIITILVTATASSVGAAGIPAGGVLTLAIILEAVNLPVDHISLILAVDWLVDRSCTVLNVEGDALGAGLLQNYVDRTESRSTEPELIQVKSELPLDPLPVPTEEGNPLLKHYRGPAGDATVASEKESVM

SEQ ID NO: 1245 - protein, 15 aa, Homo sapiens
SNYYDAYQAQPLATR

SEQ ID NO: 1246 - protein, 230 aa, Homo sapiens
MASLGLQLVGYILGLLGLLGTLVAMLLPSWKTSSYVGASIVTAVGFSKGLWMECATHSTGITQCDIYSTLLGLPADIQAAQAMMVTSSAISSLACIISVVGMRCTVFCQESRAKDRVAVAGGVFFILGGLLGFIPVAWNLHGILRDFYSPLVPDSMKFEIGEALYLGIISSLFSLIAGIILCFSCSSQRNRSNYYDAYQAQPLATRSSPRPGQPPKVKSEFNSYSLTGYV

SEQ ID NO: 1247 - protein, 15 aa, Homo sapiens
IYPLPDDPSVPAPPR

SEQ ID NO: 1248 - protein, 15 aa, Homo sapiens
AVFVDLEPTVIDEVR

SEQ ID NO: 1249 - protein, 9 aa, Homo sapiens
EIIDLVLDR

SEQ ID NO: 1250 - protein, 451 aa, Homo sapiens
MRECISIHVGQAGVQIGNACWELYCLEHGIQPDGQMPSDKTIGGGDDSFNTFFSETGAGKHVPRAVFVDLEPTVIDEVRTGTYRQLFHPEQLITGKEDAANNYARGHYTIGKEIIDLVLDRIRKLADQCTGLQGFLVFHSFGGGTGSGFTSLLMERLSVDYGKKSKLEFSIYPAPQVSTAVVEPYNSILTTHTTLEHSDCAFMVDNEAIYDICRRNLDIERPTYTNLNRLIGQIVSSITASLRFDGALNVDLTEFQTNLVPYPRIHFPLATYAPVISAEKAYHEQLSVAEITNACFEPANQMVKCDPRHGKYMACCLLYRGDVVPKDVNAAIATIKTKRTIQFVDWCPTGFKVGINYQPPTVVPGGDLAKVQRAVCMLSNTTAIAEAWARLDHKFDLMYAKRAFVHWYVGEGMEEGEFSEAREDMAALEKDYEEVGVDSVEGEGEEEGEEY

SEQ ID NO: 1251 - protein, 28 aa, Homo sapiens
AGVLADDHLIEVNGENVEDASHEEVVEK

SEQ ID NO: 1252 - protein, 27 aa, Homo sapiens
EAPAPTPTSLEVSSPPDTTEEVDHKPK

SEQ ID NO: 1253 - protein, 19 aa, Homo sapiens
INGVFVDKEEHMQVVDLVR

SEQ ID NO: 1254 - protein, 15 aa, Homo sapiens
GVYMTDITPQGVAMR

SEQ ID NO: 1255 - protein, 12 aa, Homo sapiens
MTDITPQGVAMR

SEQ ID NO: 1256 - protein, 8 aa, Homo sapiens
VMFLLVDK

SEQ ID NO: 1257 - protein, 13 aa, Homo sapiens
VMFLLVDKETDKR

SEQ ID NO: 1258 - protein, 8 aa, Homo sapiens
AYDYFQAK

SEQ ID NO: 1259 - protein, 519 aa, Homo sapiens
MTSTFNPRECKLSKQEGQNYGFFLRIEKDTEGHLVRVVEKCSPAEKAGLQDGDRVLRINGVFVDKEEHMQVVDLVRKSGNSVTLLVLDGDSYEKAVKTRVDLKELGQSQKEQGLSDNILSPVMNGGVQTWTQPRLCYLVKEGGSYGFSLKTVQGKKGVYMTDITPQGVAMRAGVLADDHLIEVNGENVEDASHEEVVEKVKKSGSRVMFLLVDKETDKRHVEQKIQFKRETASLKLLPHQPRIVEMKKGSNGYGFYLRAGSEQKGQIIKDIDSGSPAEEAGLKNNDLVVAVNGESVETLDHDSVVEMIRKGGDQTSLLVVDKETDNMYRLAHFSPFLYYQSQELPNGSVKEAPAPTPTSLEVSSPPDTTEEVDHKPKLCRLAKGENGYGFHLNAIRGLPGSFIKEVQKGGPADLAGLEDEDVIIEVNGVNVLDEPYEKVVDRIQSSGKNVTLLVCGKKAYDYFQAKKIPIVSSLADPLDTPPDSKEGIVVESNHDSHMAKERAHSTASHSSSNSEDTEM

SEQ ID NO: 1260 - protein, 14 aa, Homo sapiens
FGQGSGPIVLDDVR

SEQ ID NO: 1261 - protein, 16 aa, Homo sapiens
EFDGIGAVSGGGATSR

SEQ ID NO: 1262 - protein, 685 aa, Homo sapiens
MAEWLLSASWQRRAKAMTAAAGSAGRAAVPLLLCALLAPGGAYVLDDSDGLGREFDGIGAVSGGGATSRLLVNYPEPYRSQILDYLFKPNFGASLHILKVEIGGDGQTTDGTEPSHMHYALDENYFRGYEWWLMKEAKKRNPNITLIGLPWSFPGWLGKGFDWPYVNLQLTAYYVVTWIVGAKRYHDLDIDYIGIWNERSYNANYIKILRKMLNYQGLQRVKIIASDNLWESISASMLLDAELFKVVDVIGAHYPGTHSAKDAKLTGKKLWSSEDFSTLNSDMGAGCWGRILNQNYINGYMTSTIAWNLVASYYEQLPYGRCGLMTAQEPWSGHYVVESPVWVSAHTTQFTQPGWYYLKTVGHLEKGGSYVALTDGLGNLTIIIETMSHKHSKCIRPFLPYFNVSQQFATFVLKGSFSEIPELQVWYTKLGKTSERFLFKQLDSLWLLDSDGSFTLSLHEDELFTLTTLTTGRKGSYPLPPKSQPFPSTYKDDFNVDYPFFSEAPNFADQTGVFEYFTNIEDPGEHHFTLRQVLNQRPITWAADASNTISIIGDYNWTNLTIKCDVYIETPDTGGVFIAGRVNKGGILIRSARGIFFWIFANGSYRVTGDLAGWIIYALGRVEVTAKKWYTLTLTIKGHFTSGMLNDKSLWTDIPVNFPKNGWAAIGTHSFEFAQFDNFLVEATR

SEQ ID NO: 1263 - protein, 22 aa, Homo sapiens
LPNLSSPSAEGPPGPPSGPAPR

SEQ ID NO: 1264 - protein, 16 aa, Homo sapiens
SSPDLTGVVTIYEDLR

SEQ ID NO: 1265 - protein, 24 aa, Homo sapiens
TGQPDLLGTGTLGPSPTATGTLGR

SEQ ID NO: 1266 - protein, 19 aa, Homo sapiens
SPESLPAGPGAAALEGGTR

SEQ ID NO: 1267 - protein, 19 aa, Homo sapiens
VPVAAAEVPGAAAEEAPGR

SEQ ID NO: 1268 - protein, 158 aa, Homo sapiens
MGSGSSRSSRTLRRRRSPESLPAGPGAAALEGGTRRRVPVAAAEVPGAAAEEAPGRDPSPVAPPDGRDETLRLLDELLAESAAWGPPEPAPRRPARLRPTAVAGSAVCAEQSTEGHPGSGNVSEAPGSGRKKPERPAAISYDHSEEGLMASIEREYCR

SEQ ID NO: 1269 - protein, 10 aa, Homo sapiens
LETFIQEHLR

SEQ ID NO: 1270 - protein, 14 aa, Homo sapiens
DTFNHLTTWLEDAR

SEQ ID NO: 1271 - protein, 212 aa, Homo sapiens
MAYAYLFKYIIIGDTGVGKSCLLLQFTDKRFQPVHDLTIGVEFGARMITIDGKQIKLQIWDTAGQESFRSITRSYYRGAAGALLVYDITRRDTFNHLTTWLEDARQHSNSNMVIMLIGNKSDLESRREVKKEEGEAFAREHGLIFMETSAKTASNVEEAFINTAKEIYEKIQEGVFDINNEANGIKIGPQHAATNATHAGNQGGQQAGGGCC

SEQ ID NO: 1272 - protein, 21 aa, Homo sapiens
GNILIPGINEAVAAVTEEEHK

SEQ ID NO: 1273 - protein, 16 aa, Homo sapiens
LPDGSEIPLPPILLGR

SEQ ID NO: 1274 - protein, 14 aa, Homo sapiens
LYDDIDFDIEEFAK

SEQ ID NO: 1275 - protein, 18 aa, Homo sapiens
QKLPDGSEIPLPPILLGR

SEQ ID NO: 1276 - protein, 11 aa, Homo sapiens
TVFGVEPDLTR

SEQ ID NO: 1277 - protein, 475 aa, Homo sapiens
MAALTTLFKYIDENQDRYIKKLAKWVAIQSVSAWPEKRGEIRRMMEVAAADVKQLGGSVELVDIGKQKLPDGSEIPLPPILLGRLGSDPQKKTVCIYGHLDVQPAALEDGWDSEPFTLVERDGKLYGGGSTDDKGPVAGWINALEAYQKTGQEIPVNVRFCLEGMEESGSEGLDELIFARKDTFFKDVDYVCISDNYWLGKKKPCITYGLRGICYFFIEVECSNKDLHSGVYGGSVHEAMTDLILLMGSLVDKRGNILIPGINEAVAAVTEEEHKLYDDIDFDIEEFAKDVGAQILLHSHKKDILMHRWRYPSLSLHGIEGAFSGSGAKTVIPRKVVGKFSIRLVPNMTPEVVGEQVTSYLTKKFAELRSPNEFKVYMGHGGKPWVSDFSHPHYLAGRRAMKTVFGVEPDLTREGGSIPVTLTFQEATGKNVMLLPVGSADDGAHSQNEKLNRYNYIEGTKMLAAYLYEVSQLKD

SEQ ID NO: 1278 - protein, 20 aa, Homo sapiens
NLEQLGGTVTNPGGSGTSSR

SEQ ID NO: 1279 - protein, 9 aa, Homo sapiens
VLLLYILLR

SEQ ID NO: 1280 - protein, 12 aa, Homo sapiens
VGWEQLLTTIAR

SEQ ID NO: 1281 - protein, 911 aa, Homo sapiens
MVDYHAANQSYQYGPSSAGNGAGGGGSMGDYMAQEDDWDRDLLLDPAWEKQQRKTFTAWCNSHLRKAGTQIENIDEDFRDGLKLMLLLEVISGERLPKPERGKMRVHKINNVNKALDFIASKGVKLVSIGAEEIVDGNAKMTLGMIWTIILRFAIQDISVEETSAKEGLLLWCQRKTAPYKNVNVQNFHISWKDGLAFNALIHRHRPELIEYDKLRKDDPVTNLNNAFEVAEKYLDIPKMLDAEDIVNTARPDEKAIMTYVSSFYHAFSGAQKAETAANRICKVLAVNQENEHLMEDYEKLASDLLEWIRRTIPWLEDRVPQKTIQEMQQKLEDFRDYRRVHKPPKVQEKCQLEINFNTLQTKLRLSNRPAFMPSEGKMVSDINNGWQHLEQAEKGYEEWLLNEIRRLERLDHLAEKFRQKASIHEAWTDGKEAMLKHRDYETATLSDIKALIRKHEAFESDLAAHQDRVEQIAAIAQELNELDYYDSHNVNTRCQKICDQWDALGSLTHSRREALEKTEKQLEAIDQLHLEYAKRAAPFNNWMESAMEDLQDMFIVHTIEEIEGLISAHDQFKSTLPDADREREAILAIHKEAQRIAESNHIKLSGSNPYTTVTPQIINSKWEKVQQLVPKRDHALLEEQSKQQSNEHLRRQFASQANVVGPWIQTKMEEIGRISIEMNGTLEDQLSHLKQYERSIVDYKPNLDLLEQQHQLIQEALIFDNKHTNYTMEHIRVGWEQLLTTIARTINEVENQILTRDAKGISQEQMQEFRASFNHFDKDHGGALGPEEFKACLISLGYDVENDRQGEAEFNRIMSLVDPNHSGLVTFQAFIDFMSRETTDTDTADQVIASFKVLAGDKNFITAEELRRELPPDQAEYCIARMAPYQGPDAVPGALDYKSFSTALYGESDL

SEQ ID NO: 1282 - protein, 19 aa, Homo sapiens
AFAPGTGLGGDAHFDEDER

SEQ ID NO: 1283 - protein, 13 aa, Homo sapiens
FFGLPITGMLNSR

SEQ ID NO: 1284 - protein, 267 aa, Homo sapiens
MRLTVLCAVCLLPGSLALPLPQEAGGMSELQWEQAQDYLKRFYLYDSETKNANSLEAKLKEMQKFFGLPITGMLNSRVIEIMQKPRCGVPDVAEYSLFPNSPKWTSKVVTYRIVSYTRDLPHITVDRLVSKALNMWGKEIPLHFRKVVWGTADIMIGFARGAHGDSYPFDGPGNTLAHAFAPGTGLGGDAHFDEDERWTDGSSLGINFLYAATHELGHSLGMGHSSDPNAVMYPTYGNGDPQNFKLSQDDIKGIQKLYGKRSNSRKK

SEQ ID NO: 1285 - protein, 15 aa, Homo sapiens
QISNLQQSISDAEQR

SEQ ID NO: 1286 - protein, 16 aa, Homo sapiens
THNLEPYFESFINNLR

SEQ ID NO: 1287 - protein, 10 aa, Homo sapiens
NKYEDEINKR

SEQ ID NO: 1288 - protein, 644 aa, Homo sapiens
MSRQFSSRSGYRSGGGFSSGSAGIINYQRRTTSSSTRRSGGGGGRFSSCGGGGGSFGAGGGFGSRSLVNLGGSKSISISVARGGGRGSGFGGGYGGGGFGGGGFGGGGFGGGGIGGGGFGGFGSGGGGFGGGGFGGGGYGGGYGPVCPPGGIQEVTINQSLLQPLNVEIDPEIQKVKSREREQIKSLNNQFASFIDKVRFLEQQNQVLQTKWELLQQVDTSTRTHNLEPYFESFINNLRRRVDQLKSDQSRLDSELKNMQDMVEDYRNKYEDEINKRTNAENEFVTIKKDVDGAYMTKVDLQAKLDNLQQEIDFLTALYQAELSQMQTQISETNVILSMDNNRSLDLDSIIAEVKAQYEDIAQKSKAEAESLYQSKYEELQITAGRHGDSVRNSKIEISELNRVIQRLRSEIDNVKKQISNLQQSISDAEQRGENALKDAKNKLNDLEDALQQAKEDLARLLRDYQELMNTKLALDLEIATYRTLLEGEESRMSGECAPNVSVSVSTSHTTISGGGSRGGGGGGYGSGGSSYGSGGGSYGSGGGGGGGRGSYGSGGSSYGSGGGSYGSGGGGGGHGSYGSGSSSGGYRGGSGGGGGGSSGGRGSGGGSSGGSIGGRGSSSGGVKSSGGSSSVKFVSTTYSGVTR

SEQ ID NO: 1289 - protein, 14 aa, Homo sapiens
CSTSPLLEACEFLR

SEQ ID NO: 1290 - protein, 12 aa, Homo sapiens
DEYELLCPDNTR

SEQ ID NO: 1291 - protein, 14 aa, Homo sapiens
DSPIQCIQAIAENR

SEQ ID NO: 1292 - protein, 18 aa, Homo sapiens
DVTVLQNTDGNNNEAWAK

SEQ ID NO: 1293 - protein, 14 aa, Homo sapiens
ESTVFEDLSDEAER

SEQ ID NO: 1294 - protein, 26 aa, Homo sapiens
ESTVFEDLSDEAERDEYELLCPDNTR

SEQ ID NO: 1295 - protein, 16 aa, Homo sapiens
FDEYFSQSCAPGSDPR

SEQ ID NO: 1296 - protein, 11 aa, Homo sapiens
FQLFGSPSGQK

SEQ ID NO: 1297 - protein, 13 aa, Homo sapiens
GGSFQLNELQGLK

SEQ ID NO: 1298 - protein, 19 aa, Homo sapiens
IDSGLYLGSGYFTAIQNLR

SEQ ID NO: 1299 - protein, 9 aa, Homo sapiens
QVLLHQQAK

SEQ ID NO: 1300 - protein, 14 aa, Homo sapiens
YLGPQYVAGITNLK

SEQ ID NO: 1301 - protein, 710 aa, Homo sapiens
MKLVFLVLLFLGALGLCLAGRRRSVQWCAVSQPEATKCFQWQRNMRKVRGPPVSCIKRDSPIQCIQAIAENRADAVTLDGGFIYEAGLAPYKLRPVAAEVYGTERQPRTHYYAVAVVKKGGSFQLNELQGLKSCHTGLRRTAGWNVPIGTLRPFLNWTGPPEPIEAAVARFFSASCVPGADKGQFPNLCRLCAGTGENKCAFSSQEPYFSYSGAFKCLRDGAGDVAFIRESTVFEDLSDEAERDEYELLCPDNTRKPVDKFKDCHLARVPSHAVVARSVNGKEDAIWNLLRQAQEKFGKDKSPKFQLFGSPSGQKDLLFKDSAIGFSRVPPRIDSGLYLGSGYFTAIQNLRKSEEEVAARRARVVWCAVGEQELRKCNQWSGLSEGSVTCSSASTTEDCIALVLKGEADAMSLDGGYVYTAGKCGLVPVLAENYKSQQSSDPDPNCVDRPVEGYLAVAVVRRSDTSLTWNSVKGKKSCHTAVDRTAGWNIPMGLLFNQTGSCKFDEYFSQSCAPGSDPRSNLCALCIGDEQGENKCVPNSNERYYGYTGAFRCLAENAGDVAFVKDVTVLQNTDGNNNEAWAKDLKLADFALLCLDGKRKPVTEARSCHLAMAPNHAVVSRMDKVERLKQVLLHQQAKFGRNGSDCPDKFCLFQSETKNLLFNDNTECLARLHGKTTYEKYLGPQYVAGITNLKKCSTSPLLEACEFLRK

SEQ ID NO: 1302 - protein, 28 aa, Homo sapiens
LTLSGSDSVILGDTTTSGASDEEDGQPR

SEQ ID NO: 1303 - protein, 20 aa, Homo sapiens
LVAEDAPSPAAPPLSSGGPR

SEQ ID NO: 1304 - protein, 15 aa, Homo sapiens
QALASLTPGTGQALR

SEQ ID NO: 1305 - protein, 1336 aa, Homo sapiens
MENLPAVTTEEPTPMGRGPVGPSGGGSTRDQVRTVVMRPSVSWEKAGPEEAKAPVRGDEAPPARVAGPAAGTPPCQMGVYPTDLTLQLLAVRRKSRLRDPGLQQTLRGQLRLLENDSREMARVLGELSARLLSIHSDQDRIVVTFKTFEEIWKFSTYHALGFTHHCLANLLMDQAFWLLLPSEEEETAIQVHVDENALRLTHESLLIQEGPFFVLCPDHHVRVMTGPRDAGNGPQALRQASGAPQGEAAPETDSSPPSPSVSSEEVAVAAAPEPLIPFHQWALRIPQDPIDDAMGGPVMPGNPLMAVGLASALADFQGSGPEEMTFRGGDLIEILGAQVPSLPWCVGRHAASGRVGFVRSSLISMQGPVSELESAIFLNEEEKSFFSEGCFSEEDARQLLRRMSGTDVCSVYSLDSVEEAETEQPQEKEIPPPCLSPEPQETLQKVKNVLEQCKTCPGCPQEPASWGLCAASSDVSLQDPEEPSFCLEAEDDWEDPEALSSLLLFLNAPGYKASFRGLYDVALPWLSSVFRSFSDEEELTGRLAQARGAAKKAGLLMALARLCFLLGRLCSRRLKLSQARVYFEEALGALEGSFGDLFLVVAVYANLASIYRKQKNREKCAQVVPKAMALLLGTPDHICSTEAEGELLQLALRRAVGGQSLQAEARACFLLARHHVHLKQPEEALPFLERLLLLHRDSGAPEAAWLSDCYLLLADIYSRKCLPHLVLSCVKVASLRTRGSLAGSLRSVNLVLQNAPQPHSLPAQTSHYLRQALASLTPGTGQALRGPLYTSLAQLYSHHGCHGPAITFMTQAVEASAIAGVRAIVDHLVALAWLHVLHGQSPVALDILQSVRDAVVASEDQEGVIANMVAVALKRTGRTRQAAESYYRALRVARDLGQQRNQAVGLANFGALCLHAGASRLAQHYLLEAVRLFSRLPLGECGRDFTHVLLQLGHLCTRQGPAQQGKGYYEWALLVAVEMGHVESQLRAVQRLCHFYSAVMPSEAQCVIYHELQLSLACKVADKVLEGQLLETISQLYLSLGTERAYKSALDYTKRSLGIFIDLQKKEKEAHAWLQAGKIYYILRQSELVDLYIQVAQNVALYTGDPNLGLELFEAAGDIFFDGAWEREKAVSFYRDRALPLAVTTGNRKAELRLCNKLVALLATLEEPQEGLEFAHMALALSITLGDRLNERVAYHRLAALQHRLGHGELAEHFYLKALSLCNSPLEFDEETLYYVKVYLVLGDIIFYDLKDPFDAAGYYQLALAAAVDLGNKKAQLKIYTRLATIYHNFLLDREKSLFFYQKARTFATELNVRRVNLPPLPLCGWAPWLAPSHPR

SEQ ID NO: 1306 - protein, 18 aa, Homo sapiens
DMNLTLEPEIMPAATDNR

SEQ ID NO: 1307 - protein, 13 aa, Homo sapiens
GPEEEHPSVTLFR

SEQ ID NO: 1308 - protein, 20 aa, Homo sapiens
TVQPKPDYGAAVAFFEETAR

SEQ ID NO: 1309 - protein, 408 aa, Homo sapiens
MTSKGPEEEHPSVTLFRQYLRIRTVQPKPDYGAAVAFFEETARQLGLGCQKVEVAPGYVVTVLTWPGTNPTLSSILLNSHTDVVPVFKEHWSHDPFEAFKDSEGYIYARGAQDMKCVSIQYLEAVRRLKVEGHRFPRTIHMTFVPDEEVGGHQGMELFVQRPEFHALRAGFALDEGIANPTDAFTVFYSERSPWWVRVTSTGRPGHASRFMEDTAAEKLHKVVNSILAFREKEWQRLQSNPHLKEGSVTSVNLTKLEGGVAYNVIPATMSASFDFRVAPDVDFKAFEEQLQSWCQAAGEGVTLEFAQKWMHPQVTPTDDSNPWWAAFSRVCKDMNLTLEPEIMPAATDNRYIRAVGVPALGFSPMNRTPVLLHDHDERLHEAVFLRGVDIYTRLLPALASVPALPSDS

SEQ ID NO: 1310 - protein, 7 aa, Homo sapiens
CNFYDNK

SEQ ID NO: 1311 - protein, 13 aa, Homo sapiens
DLECVTNLQEVAR

SEQ ID NO: 1312 - protein, 11 aa, Homo sapiens
HLHYWFVESQK

SEQ ID NO: 1313 - protein, 9 aa, Homo sapiens
NFLVNLQYR

SEQ ID NO: 1314 - protein, 7 aa, Homo sapiens
QYSGYLK

SEQ ID NO: 1315 - protein, 13 aa, Homo sapiens
YGDSGEQIAGFVK

SEQ ID NO: 1316 - protein, 21 aa, Homo sapiens
YATNDTEVAQSNFEALQDFFR

SEQ ID NO: 1317 - protein, 23 aa, Homo sapiens
ALNIPEQLPQWDMCNFLVNLQYR

SEQ ID NO: 1318 - protein, 8 aa, Homo sapiens
EFSHIAFL

SEQ ID NO: 1319 - protein, 498 aa, Homo sapiens
MTSSPRAPPGEQGRGGAEMIRAAPPPLFLLLLLLLLLVSWASRGEAAPDQDEIQRLPGLAKQPSFRQYSGYLKGSGSKHLHYWFVESQKDPENSPVVLWLNGGPGCSSLDGLLTEHGPFLVQPDGVTLEYNPYSWNLIANVLYLESPAGVGFSYSDDKFYATNDTEVAQSNFEALQDFFRLFPEYKNNKLFLTGESYAGIYIPTLAVLVMQDPSMNLQGLAVGNGLSSYEQNDNSLVYFAYYHGLLGNRLWSSLQTHCCSQNKCNFYDNKDLECVTNLQEVARIVGNSGLNIYNLYAPCAGGVPSHFRYEKDTVVVQDLGNIFTRLPLKRMWHQALLRSGDKVRMDPPCTNTTAASTYLNNPYVRKALNIPEQLPQWDMCNFLVNLQYRRLYRSMNSQYLKLLSSQKYQILLYNGDVDMACNFMGDEWFVDSLNQKMEVQRRPWLVKYGDSGEQIAGFVKEFSHIAFLTIKGAGHMVPTDKPLAAFTMFSRFLNKQPY

SEQ ID NO: 1320 - protein, 15 aa, Homo sapiens
AGLYGQQPANQVIIR

SEQ ID NO: 1321 - protein, 11 aa, Homo sapiens
GQQPANQVIIR

SEQ ID NO: 1322 - protein, 19 aa, Homo sapiens
NWFDLWSDGHLIYYDDQTR

SEQ ID NO: 1323 - protein, 11 aa, Homo sapiens
VHMPMDCINIR

SEQ ID NO: 1324 - protein, 15 aa, Homo sapiens
DLATALEQLLQAYPR

SEQ ID NO: 1325 - protein, 18 aa, Homo sapiens
AAVPSGASTGIYEALELR

SEQ ID NO: 1326 - protein, 30 aa, Homo sapiens
HIADLAGNSEVILPVPAFNVINGGSHAGNK

SEQ ID NO: 1327 - protein, 12 aa, Homo sapiens
YISPDQLADLYK

SEQ ID NO: 1328 - protein, 14 aa, Homo sapiens
VVIGMDVAASEFFR

SEQ ID NO: 1329 - protein, 6 aa, Homo sapiens
YDLDFK

SEQ ID NO: 1330 - protein, 434 aa, Homo sapiens
MSILKIHAREIFDSRGNPTVEVDLFTSKGLFRAAVPSGASTGIYEALELRDNDKTRYMGKGVSKAVEHINKTIAPALVSKKLNVTEQEKIDKLMIEMDGTENKSKFGANAILGVSLAVCKAGAVEKGVPLYRHIADLAGNSEVILPVPAFNVINGGSHAGNKLAMQEFMILPVGAANFREAMRIGAEVYHNLKNVIKEKYGKDATNVGDEGGFAPNILENKEGLELLKTAIGKAGYTDKVVIGMDVAASEFFRSGKYDLDFKSPDDPSRYISPDQLADLYKSFIKDYPVVSIEDPFDQDDWGAWQKFTASAGIQVVGDDLTVTNPKRIAKAVNEKSCNCLLLKVNQIGSVTESLQACKLAQANGWGVMVSHRSGETEDTFIADLVVGLCTGQIKTGAPCRSERLAKYNQLLRIEEELGSKAKFAGRNFRNPLAK

SEQ ID NO: 1331 - protein, 11 aa, Homo sapiens
FQELIFEDFAR

SEQ ID NO: 1332 - protein, 19 aa, Homo sapiens
EASPESPPPASPDGVTEIR

SEQ ID NO: 1333 - protein, 12 aa, Homo sapiens
SIVEEIEDLVAR

SEQ ID NO: 1334 - protein, 14 aa, Homo sapiens
AFSELLDLVGGLGR

SEQ ID NO: 1335 - protein, 17 aa, Homo sapiens
GAVQDTLTPEVLLSAMR

SEQ ID NO: 1336 - protein, 553 aa, Homo sapiens
MAFSELLDLVGGLGRFQVLQTMALMVSIMWLCTQSMLENFSAAVPSHRCWAPLLDNSTAQASILGSLSPEALLAISIPPGPNQRPHQCRRFRQPQWQLLDPNATATSWSEADTEPCVDGWVYDRSIFTSTIVAKWNLVCDSHALKPMAQSIYLAGILVGAAACGPASDRFGRRLVLTWSYLQMAVMGTAAAFAPAFPVYCLFRFLLAFAVAGVMMNTGTLLMEWTAARARPLVMTLNSLGFSFGHGLTAAVAYGVRDWTLLQLVVSVPFFLCFLYSWWLAESARWLLTTGRLDWGLQELWRVAAINGKGAVQDTLTPEVLLSAMREELSMGQPPASLGTLLRMPGLRFRTCISTLCWFAFGFTFFGLALDLQALGSNIFLLQMFIGVVDIPAKMGALLLLSHLGRRPTLAASLLLAGLCILANTLVPHEMGALRSALAVLGLGGVGAAFTCITIYSSELFPTVLRMTAVGLGQMAARGGAILGPLVRLLGVHGPWLPLLVYGTVPVLSGLAALLLPETQSLPLPDTIQDVQNQAVKKATHGTLGNSVLKSTQF

SEQ ID NO: 1337 - protein, 16 aa, Homo sapiens
QLTQIDGTLSTIEFQR

SEQ ID NO: 1338 - protein, 233 aa, Homo sapiens
MSKLGKFFKGGGSSKSRAAPSPQEALVRLRETEEMLGKKQEYLENRIQREIALAKKHGTQNKRAALQALKRKKRFEKQLTQIDGTLSTIEFQREALENSHTNTEVLRNMGFAAKAMKSVHENMDLNKIDDLMQEITEQQDIAQEISEAFSQRVGFGDDFDEDELMAELEELEQEELNKKMTNIRLPNVPSSSLPAQPNRKPGMSSTARRSRAASSQRAEEEDDDIKQLAAWAT

SEQ ID NO: 1339 - protein, 9 aa, Homo sapiens
NHPSVSWLK

SEQ ID NO: 1340 - protein, 15 aa, Homo sapiens
ISETSLPPDMYECLR

SEQ ID NO: 1341 - protein, 338 aa, Homo sapiens
MSLSAFTLFLALIGGTSGQYYDYDFPLSIYGQSSPNCAPECNCPESYPSAMYCDELKLKSVPMVPPGIKYLYLRNNQIDHIDEKAFENVTDLQWLILDHNLLENSKIKGRVFSKLKQLKKLHINHNNLTESVGPLPKSLEDLQLTHNKITKLGSFEGLVNLTFIHLQHNRLKEDAVSAAFKGLKSLEYLDLSFNQIARLPSGLPVSLLTLYLDNNKISNIPDEYFKRFNALQYLRLSHNELADSGIPGNSFNVSSLVELDLSYNKLKNIPTVNENLENYYLEVNQLEKFDIKSFCKILGPLSYSKIKHLRLDGNRISETSLPPDMYECLRVANEVTLN

SEQ ID NO: 1342 - protein, 6 aa, Homo sapiens
HLFNLK

SEQ ID NO: 1343 - protein, 199 aa, Homo sapiens
MSNMEKHLFNLKFAAKELSRSAKKCDKEEKAEKAKIKKAIQKGNMEVARIHAENAIRQKNQAVNFLRMSARVDAVAARVQTAVTMGKVTKSMAGVVKSMDATLKTMNLEKISALMDKFEHQFETLDVQTQQMEDTMSSTTTLTTPQNQVDMLLQEMADEAGLDLNMELPQGQTGSVGTSVASAEQDELSQRLARLRDQV

SEQ ID NO: 1344 - protein, 19 aa, Homo sapiens
QAVGGAGPPNPAINGSAPR

SEQ ID NO: 1345 - protein, 12 aa, Homo sapiens
APLVCLPVFVSR

SEQ ID NO: 1346 - protein, 9 aa, Homo sapiens
FLPAEFLYR

SEQ ID NO: 1347 - protein, 8 aa, Homo sapiens
WLHFYEMK

SEQ ID NO: 1348 - protein, 265 aa, Homo sapiens
MACAEFSFHVPSLEELAGVMQKGLKDNFADVQVSVVDCPDLTKEPFTFPVKGICGKTRIAEVGGVPYLLPLVNQKKVYDLNKIAKEIKLPGAFILGAGAGPFQTLGFNSEFMPVIQTESEHKPPVNGSYFAHVNPADGGCLLEKYSEKCHDFQCALLANLFASEGQPGKPAEFSSCPLNSDEEVNKWLHFYEMKAPLVCLPVFVSRDPGFDLRLEHTHFFSRHGEGGHYHYDTTPDIVEYLGYFLPAEFLYRIDQPKETHSIGRD

SEQ ID NO: 1349 - protein, 15 aa, Homo sapiens
LEDLITVITQTESHR

SEQ ID NO: 1350 - protein, 6 aa, Homo sapiens
IFEYFR

SEQ ID NO: 1351 - protein, 19 aa, Homo sapiens
YESLDYDNSENQLFLEEER

SEQ ID NO: 1352 - protein, 12 aa, Homo sapiens
APETFDNITISR

SEQ ID NO: 1353 - protein, 13 aa, Homo sapiens
KLQNWNFLPLWMR

SEQ ID NO: 1354 - protein, 15 aa, Homo sapiens
YLEGAAGQQPTAPDK

SEQ ID NO: 1355 - protein, 12 aa, Homo sapiens
LQNWNFLPLWMR

SEQ ID NO: 1356 - protein, 8 aa, Homo sapiens
NFLPLWMR

SEQ ID NO: 1357 - protein, 690 aa, Homo sapiens
MAPWPELGDAQPNPDKYLEGAAGQQPTAPDKSKETNKTDNTEAPVTKIELLPSYSTATLIDEPTEVDDPWNLPTLQDSGIKWSERDTKGKILCFFQGIGRLILLLGFLYFFVCSLDILSSAFQLVGGKMAGQFFSNSSIMSNPLLGLVIGVLVTVLVQSSSTSTSIVVSMVSSSLLTVRAAIPIIMGANIGTSITNTIVALMQVGDRSEFRRAFAGATVHDFFNWLSVLVLLPVEVATHYLEIITQLIVESFHFKNGEDAPDLLKVITKPFTKLIVQLDKKVISQIAMNDEKAKNKSLVKIWCKTFTNKTQINVTVPSTANCTSPSLCWTDGIQNWTMKNVTYKENIAKCQHIFVNFHLPDLAVGTILLILSLLVLCGCLIMIVKILGSVLKGQVATVIKKTINTDFPFPFAWLTGYLAILVGAGMTFIVQSSSVFTSALTPLIGIGVITIERAYPLTLGSNIGTTTTAILAALASPGNALRSSLQIALCHFFFNISGILLWYPIPFTRLPIRMAKGLGNISAKYRWFAVFYLIIFFFLIPLTVFGLSLAGWRVLVGVGVPVVFIIILVLCLRLLQSRCPRVLPKKLQNWNFLPLWMRSLKPWDAVVSKFTGCFQMRCCCCCRVCCRACCLLCGCPKCCRCSKCCEDLEEAQEGQDVPVKAPETFDNITISREAQGEVPASDSKTECTAL

SEQ ID NO: 1358 - protein, 24 aa, Homo sapiens
ELQAEATVSGSPEAPGTNVVSEPR

SEQ ID NO: 1359 - protein, 441 aa, Homo sapiens
MKKFFQEFKADIKFKSAGPGQKLKESVGEKAHKEKPNQPAPRPPRQGPTNEAQMAAAAALARLEQKQSRAWGPTSQDTIRNQVRKELQAEATVSGSPEAPGTNVVSEPREEGSAHLAVPGVYFTCPLTGATLRKDQRDACIKEAILLHFSTDPVAASIMKIYTFNKDQDRVKLGVDTIAKYLDNIHLHPEEEKYRKIKLQNKVFQERINCLEGTHEFFEAIGFQKVLLPAQDQEDPEEFYVLSETTLAQPQSLERHKEQLLAAEPVRAKLDRQRRVFQPSPLASQFELPGDFFNLTAEEIKREQRLRSEAVERLSVLRTKAMREKEEQRGLRKYNYTLLRVRLPDGCLLQGTFYARERLGAVYGFVREALQSDWLPFELLASGGQKLSEDENLALNECGLVPSALLTFSWDMAVLEDIKAAGAEPDSILKPELLSAIEKLL

SEQ ID NO: 1360 - protein, 9 aa, Homo sapiens
VLELLLPIR

SEQ ID NO: 1361 - protein, 469 aa, Homo sapiens
MAAASPLRDCQAWKDARLPLSTTSNEACKLFDATLTQYVKWTNDKSLGGIEGCLSKLKAADPTFVMGHAMATGLVLIGTGSSVKLDKELDLAVKTMVEISRTQPLTRREQLHVSAVETFANGNFPKACELWEQILQDHPTDMLALKFSHDAYFYLGYQEQMRDSVARIYPFWTPDIPLSSYVKGIYSFGLMETNFYDQAEKLAKEALSINPTDAWSVHTVAHIHEMKAEIKDGLEFMQHSETLWKDSDMLACHNYWHWALYLIEKGEYEAALTIYDTHILPSLQANDAMLDVVDSCSMLYRLQMEGVSVGQRWQDVLPVARKHSRDHILLFNDAHFLMASLGAHDPQTTQELLTTLRDASESPGENCQHLLARDVGLPLCQALVEAEDGNPDRVLELLLPIRYRIVQLGGSNAQRDVFNQLLIHAALNCTSSVHKNVARSLLMERDALKPNSPLTERLIRKAATVHLMQ

SEQ ID NO: 1362 - protein, 11 aa, Homo sapiens
VLGDVIEVHGK

SEQ ID NO: 1363 - protein, 175 aa, Homo sapiens
MDIAIHHPWIRRPFFPFHSPSRLFDQFFGEHLLESDLFPTSTSLSPFYLRPPSFLRAPSWFDTGLSEMRLEKDRFSVNLDVKHFSPEELKVKVLGDVIEVHGKHEERQDEHGFISREFHRKYRIPADVDPLTITSSLSSDGVLTVNGPRKQVSGPERTIPITREEKPAVTAAPKK

SEQ ID NO: 1364 - protein, 12 aa, Homo sapiens
AQLAEVVESMFR

SEQ ID NO: 1365 - protein, 1548 aa, Homo sapiens
MLRARPEALMLLGALLTGSLGPSGNQDALSLPWEVQRYDGWFNNLRHHERGAVGCRLQRRVPANYADGVYQALEEPQLPNPRRLSNAATRGIAGLPSLHNRTVLGVFFGYHVLSDVVSVETPGCPAEFLNIRIPPGDPVFDPDQRGDVVLPFQRSRWDPETGRSPSNPRDLANQVTGWLDGSAIYGSSHSWSDALRSFSGGQLASGPDPAFPRDSQNPLLMWAAPDPATGQNGPRGLYAFGAERGNREPFLQALGLLWFRYHNLWAQRLARQHPDWEDEELFQHARKRVIATYQNIAVYEWLPSFLQKTLPEYTGYRPFLDPSISPEFVVASEQFFSTMVPPGVYMRNASCHFRKVLNKGFQSSQALRVCNNYWIRENPNLNSTQEVNELLLGMASQISELEDNIVVEDLRDYWPGPGKFSRTDYVASSIQRGRDMGLPSYSQALLAFGLDIPRNWSDLNPNVDPQVLEATAALYNQDLSQLELLLGGLLESHGDPGPLFSAIVLDQFVRLRDGDRYWFENTRNGLFSKKEIEDIRNTTLRDVLVAVINIDPSALQPNVFVWHKGAPCPQPKQLTTDGLPQCAPLTVLDFFEGSSPGFAITIIALCCLPLVSLLLSGVVAYFRGREHKKLQKKLKESVKKEAAKDGVPAMEWPGPKERSSPIIIQLLSDRCLQVLNRHLTVLRVVQLQPLQQVNLILSNNRGCRTLLLKIPKEYDLVLLFSSEEERGAFVQQLWDFCVRWALGLHVAEMSEKELFRKAVTKQQRERILEIFFRHLFAQVLDINQADAGTLPLDSSQKVREALTCELSRAEFAESLGLKPQDMFVESMFSLADKDGNGYLSFREFLDILVVFMKGSPEDKSRLMFTMYDLDENGFLSKDEFFTMMRSFIEISNNCLSKAQLAEVVESMFRESGFQDKEELTWEDFHFMLRDHDSELRFTQLCVKGGGGGGNGIRDIFKQNISCRVSFITRTPGERSHPQGLGPPAPEAPELGGPGLKKRFGKKAAVPTPRLYTEALQEKMQRGFLAQKLQQYKRFVENYRRHIVCVAIFSAICVGVFADRAYYYGFASPPSDIAQTTLVGIILSRGTAASVSFMFSYILLTMCRNLITFLRETFLNRYVPFDAAVDFHRWIAMAAVVLAILHSAGHAVNVYIFSVSPLSLLACIFPNVFVNDGSKLPQKFYWWFFQTVPGMTGVLLLLVLAIMYVFASHHFRRRSFRGFWLTHHLYILLYALLIIHGSYALIQLPTFHIYFLVPAIIYGGDKLVSLSRKKVEISVVKAELLPSGVTYLQFQRPQGFEYKSGQWVRIACLALGTTEYHPFTLTSAPHEDTLSLHIRAVGPWTTRLREIYSSPKGNGCAGYPKLYLDGPFGEGHQEWHKFEVSVLVGGGIGVTPFASILKDLVFKSSLGSQMLCKKIYFIWVTRTQRQFEWLADIIQEVEENDHQDLVSVHIYVTQLAEKFDLRTTMLYICERHFQKVLNRSLFTGLRSITHFGRPPFEPFFNSLQEVHPQVRKIGVFSCGPPGMTKNVEKACQLVNRQDRAHFMHHYENF

SEQ ID NO: 1366 - protein, 25 aa, Homo sapiens
APEGEETEFYVSPEDLEAQLQSDER

SEQ ID NO: 1367 - protein, 198 aa, Homo sapiens
MADQRQRSLSTSGESLYHVLGLDKNATSDDIKKSYRKLALKYHPDKNPDNPEAADKFKEINNAHAILTDATKRNIYDKYGSLGLYVAEQFGEENVNTYFVLSSWWAKALFVFCGLLTCCYCCCCLCCCFNCCCGKCKPKAPEGEETEFYVSPEDLEAQLQSDEREATDTPIVIQPASATETTQLTADSHPSYHTDGFN

SEQ ID NO: 1368 - protein, 22 aa, Homo sapiens
GIVNGAAPELPVPTGGPAVGAR

SEQ ID NO: 1369 - protein, 20 aa, Homo sapiens
IPIFSAAGLPHNEIAAQICR

SEQ ID NO: 1370 - protein, 14 aa, Homo sapiens
QIYPPINVLPSLSR

SEQ ID NO: 1371 - protein, 511 aa, Homo sapiens
MALRAMRGIVNGAAPELPVPTGGPAVGAREQALAVSRNYLSQPRLTYKTVSGVNGPLVILDHVKFPRYAEIVHLTLPDGTKRSGQVLEVSGSKAVVQVFEGTSGIDAKKTSCEFTGDILRTPVSEDMLGRVFNGSGKPIDRGPVVLAEDFLDIMGQPINPQCRIYPEEMIQTGISAIDGMNSIARGQKIPIFSAAGLPHNEIAAQICRQAGLVKKSKDVVDYSEENFAIVFAAMGVNMETARFFKSDFEENGSMDNVCLFLNLANDPTIERIITPRLALTTAEFLAYQCEKHVLVILTDMSSYAEALREVSAAREEVPGRRGFPGYMYTDLATIYERAGRVEGRNGSITQIPILTMPNDDITHPIPDLTGYITEGQIYVDRQLHNRQIYPPINVLPSLSRLMKSAIGEGMTRKDHADVSNQLYACYAIGKDVQAMKAVVGEEALTSDDLLYLEFLQKFERNFIAQGPYENRTVFETLDIGWQLLRIFPKEMLKRIPQSTLSEFYPRDSAKH

SEQ ID NO: 1372 - protein, 21 aa, Homo sapiens
GQKPNIDVTDAMVDQAWDAQR

SEQ ID NO: 1373 - protein, 8 aa, Homo sapiens
LWAWESWR

SEQ ID NO: 1374 - protein, 12 aa, Homo sapiens
NQMILFGEEDVR

SEQ ID NO: 1375 - protein, 13 aa, Homo sapiens
QLRPLYEEYVVLK

SEQ ID NO: 1376 - protein, 6 aa, Homo sapiens
WSAFLK

SEQ ID NO: 1377 - protein, 805 aa, Homo sapiens [sequence omitted]

SEQ ID NO: 1378 - protein, 19 aa, Homo sapiens
DLGGSAPLAIGLSVALGHL

SEQ ID NO: 1379 - protein, 18 aa, Homo sapiens
TSGQVEEYDLDADDINSR

SEQ ID NO: 1380 - protein, 20 aa, Homo sapiens
VWTSGQVEEYDLDADDINSR

SEQ ID NO: 1381 - protein, 269 aa, Homo sapiens
MASEFKKKLFWRAVVAEFLATTLFVFISIGSALGFKYPVGNNQTAVQDNVKVSLAFGLSIATLAQSVGHISGAHLNPAVTLGLLLSCQISIFRALMYIIAQCVGAIVATAILSGITSSLTGNSLGRNDLADGVNSGQGLGIEIIGTLQLVLCVLATTDRRRRDLGGSAPLAIGLSVALGHLLAIDYTGCGINPARSFGSAVITHNFSNHWIFWVGPFIGGALAVLIYDFILAPRSSDLTDRVKVWTSGQVEEYDLDADDINSRVEMKPK

SEQ ID NO: 1382 - protein, 10 aa, Homo sapiens
LVDTLPQKPR

SEQ ID NO: 1383 - protein, 91 aa, Homo sapiens
MKLAVTLTLVTLALCCSSASAEICPSFQRVIETLLMDTPSSYEAAMELFSPDQDMREAGAQLKKLVDTLPQKPRESIIKLMEKIAQSSLCN

SEQ ID NO: 1384 - protein, 19 aa, Homo sapiens
LGRNVNMRAMNVLTEAEER

SEQ ID NO: 1385 - protein, 14 aa, Homo sapiens
GDGPVQGIINFEQK

SEQ ID NO: 1386 - protein, 154 aa, Homo sapiens [sequence omitted]

SEQ ID NO: 1387 - protein, 20 aa, Homo sapiens
EAFTDADNFGIQFPLDLDVK

SEQ ID NO: 1388 - protein, 14 aa, Homo sapiens
IIDNMGQEVITLER

SEQ ID NO: 1389 - protein, 17 aa, Homo sapiens
SGYPGPQVSYPPPPAGH

SEQ ID NO: 1390 - protein, 17 aa, Homo sapiens
IIDNMGQEVITLERPLR

SEQ ID NO: 1391 - protein, 318 aa, Homo sapiens
MDKQNSQMNASHPETNLPVGYPPQYPPTAFQGPPGYSGYPGPQVSYPPPPAGHSGPGPAGFPVPNQPVYNQPVYNQPVGAAGVPWMPAPQPPLNCPPGLEYLSQIDQILIHQQIELLEVLTGFETNNKYEIKNSFGQRVYFAAEDTDCCTRNCCGPSRPFTLRIIDNMGQEVITLERPLRCSSCCCPCCLQEIEIQAPPGVPIGYVIQTWHPCLPKFTIQNEKREDVLKISGPCVVCSCCGDVDFEIKSLDEQCVVGKISKHWTGILREAFTDADNFGIQFPLDLDVKMKAVMIGACFLIDFMFFESTGSQEQKSGVW

SEQ ID NO: 1392 - protein, 18 aa, Homo sapiens
ANIPIMDTGENPEVPFPR

SEQ ID NO: 1393 - protein, 13 aa, Homo sapiens
ASLYPCPETPQER

SEQ ID NO: 1394 - protein, 15 aa, Homo sapiens
IDDLQMVLNQTEDHR

SEQ ID NO: 1395 - protein, 19 aa, Homo sapiens
KANIPIMDTGENPEVPFPR

SEQ ID NO: 1396 - protein, 16 aa, Homo sapiens
DGDCPAVLIPSKPLAR

SEQ ID NO: 1397 - protein, 706 aa, Homo sapiens
MGDERPHYYGKHGTPQKYDPTFKGPIYNRGCTDIICCVFLLLAIVGYVAVGIIAWTHGDPRKVIYPTDSRGEFCGQKGTKNENKPYLFYFNIVKCASPLVLLEFQCPTPQICVEKCPDRYLTYLNARSSRDFEYYKQFCVPGFKNNKGVAEVLRDGDCPAVLIPSKPLARRCFPAIHAYKGVLMVGNETTYEDGHGSRKNITDLVEGAKKANGVLEARQLAMRIFEDYTVSWYWIIIGLVIAMAMSLLFIILLRFLAGIMVWVMIIMVILVLGYGIFHCYMEYSRLRGEAGSDVSLVDLGFQTDFRVYLHLRQTWLAFMIILSILEVIIILLLIFLRKRILIAIALIKEASRAVGYVMCSLLYPLVTFFLLCLCIAYWASTAVFLSTSNEAVYKIFDDSPCPFTAKTCNPETFPSSNESRQCPNARCQFAFYGGESGYHRALLGLQIFNAFMFFWLANFVLALGQVTLAGAFASYYWALRKPDDLPAFPLFSAFGRALRYHTGSLAFGALILAIVQIIRVILEYLDQRLKAAENKFAKCLMTCLKCCFWCLEKFIKFLNRNAYIMIAIYGTNFCTSARNAFFLLMRNIIRVAVLDKVTDFLFLLGKLLIVGSVGILAFFFFTHRIRIVQDTAPPLNYYWVPILTVIVGSYLIAHGFFSVYGMCVDTLFLCFLEDLERNDGSAERPYFMSSTLKKPLNKTNKKAAES

SEQ ID NO: 1398 - protein, 15 aa, Homo sapiens
ISQSNYIPTQQDVLR

SEQ ID NO: 1399 - protein, 12 aa, Homo sapiens
SNTIQSIIAIIR

SEQ ID NO: 1400 - protein, 354 aa, Homo sapiens
MGCTLSAEDKAAVERSKMIDRNLREDGEKAAKEVKLLLLGAGESGKSTIVKQMKIIHEDGYSEDECKQYKVVVYSNTIQSIIAIIRAMGRLKIDFGEAARADDARQLFVLAGSAEEGVMTPELAGVIKRLWRDGGVQACFSRSREYQLNDSASYYLNDLDRISQSNYIPTQQDVLRTRVKTTGIVETHFTFKDLYFKMFDVGGQRSERKKWIHCFEGVTAIIFCVALSDYDLVLAEDEEMNRMHESMKLFDSICNNKWFTETSIILFLNKKDLFEEKIKRSPLTICYPEYTGSNTYEEAAAYIQCQFEDLNRRKDTKEIYTHFTCATDTKNVQFVFDAVTDVIIKNNLKECGLY

SEQ ID NO: 1401 - protein, 14 aa, Homo sapiens
YNRITLNNDIMLIK

SEQ ID NO: 1402 - protein, 20 aa, Homo sapiens
GHTELLTVEQALADFAELLR

SEQ ID NO: 1403 - protein, 12 aa, Homo sapiens
DLFLQGAYDTVR

SEQ ID NO: 1404 - protein, 492 aa, Homo sapiens [sequence omitted]

SEQ ID NO: 1405 - protein, 10 aa, Homo sapiens
IQLVEEELDR

SEQ ID NO: 1406 - protein, 248 aa, Homo sapiens
MAGLNSLEAVKRKIQALQQQADEAEDRAQGLQRELDGERERREKAEGDVAALNRRIQLVEEELDRAQERLATALQKLEEAEKAADESERGMKVIENRAMKDEEKMEIQEMQLKEAKHIAEEADRKYEEVARKLVILEGELERAEERAEVSELKCGDLEEELKNVTNNLKSLEAASEKYSEKEDKYEEEIKLLSDKLKEAETRAEFAERTVAKLEKTIDDLEEKLAQAKEENVGLHQTLDQTLNELNCI

SEQ ID NO: 1407 - protein, 21 aa, Homo sapiens
NQILNLTTDNANILLQIDNAR

SEQ ID NO: 1408 - protein, 12 aa, Homo sapiens
SQYEQLAEQNRK

SEQ ID NO: 1409 - protein, 11 aa, Homo sapiens
SQYEQLAEQNR

SEQ ID NO: 1410 - protein, 13 aa, Homo sapiens
LVGILDILDEENR

SEQ ID NO: 1411 - protein, 1285 aa, Homo sapiens
MEDGKPVWAPHPTDGFQMGNIVDIGPDSLTIEPLNQKGKTFLALINQVFPAEEDSKKDVEDNCSLMYLNEATLLHNIKVRYSKDRIYTYVANILIAVNPYFDIPKIYSSEAIKSYQGKSLGTRPPHVFAIADKAFRDMKVLKMSQSIIVSGESGAGKTENTKFVLRYLTESYGTGQDIDDRIVEANPLLEAFGNAKTVRNNNSSRFGKFVEIHFNEKSSVVGGFVSHYLLEKSRICVQGKEERNYHIFYRLCAGASEDIREKLHLSSPDNFRYLNRGCTRYFANKETDKQILQNRKSPEYLKAGSMKDPLLDDHGDFIRMCTAMKKIGLDDEEKLDLFRVVAGVLHLGNIDFEEAGSTSGGCNLKNKSAQSLEYCAELLGLDQDDLRVSLTTRVMLTTAGGTKGTVIKVPLKVEQANNARDALAKTVYSHLFDHVVNRVNQCFPFETSSYFIGVLDIAGFEYFEHNSFEQFCINYCNEKLQQFFNERILKEEQELYQKEGLGVNEVHYVDNQDCIDLIEAKLVGILDILDEENRLPQPSDQHFTSAVHQKHKDHFRLTIPRKSKLAVHRNIRDDEGFIIRHFAGAVCYETTQFVEKNNDALHMSLESLICESRDKFIRELFESSTNNNKDTKQKAGKLSFISVGNKFKTQLNLLLDKLRSTGASFIRCIKPNLKMTSHHFEGAQILSQLQCSGMVSVLDLMQGGYPSRASFHELYNMYKKYMPDKLARLDPRLFCKALFKALGLNENDYKFGLTKVFFRPGKFAEFDQIMKSDPDHLAELVKRVNHWLTCSRWKKVQWCSLSVIKLKNKIKYRAEACIKMQKTIRMWLCKRRHKPRIDGLVKVGTLKKRLDKFNEVVSVLKDGKPEMNKQIKNLEISIDTLMAKIKSTMMTQEQIQKEYDALVKSSEELLSALQKKKQQEEEAERLRRIQEEMEKERKRREEDEKRRRKEEEERRMKLEMEAKRKQEEEERKKREDDEKRIQAEVEAQLARQKEEESQQQAVLEQERRDRELALRIAQSEAELISDEAQADLALRRNDGTRPKMTPEQMAKEMSEFLSRGPAVLATKAAAGTKKYDLSKWKYAELRDTINTSCDIELLAACREEFHRRLKVYHAWKSKNKKRNTETEQRAPKSVTDYDFAPFLNNSPQQNPAAQIPARQREIEMNRQQRFFRIPFIRPADQYKDPQSKKKGWWYAHFDGPWIARQMELHPDKPPILLVAGKDDMEMCELNLEETGLTRKRGAEILPRQFEEIWERCGGIQYLQNAIESRQARPTYATAMLQSLLK

SEQ ID NO: 1412 - protein, 15 aa, Homo sapiens
HLEINPDHSIIETLR

SEQ ID NO: 1413 - protein, 854 aa, Homo sapiens
MPPCSGGDGSTPPGPSLRDRDCPAQSAEYPRDRLDPRPGSPSEASSPPFLRSRAPVNWYQEKAQVFLWHLMVSGSTTLLCLWKQPFHVSAFPVTASLAFRQSQGAGQHLYKDLQPFILLRLLMPEETQTQDQPMEEEEVETFAFQAEIAQLMSLIINTFYSNKEIFLRELISNSSDALDKIRYESLTDPSKLDSGKELHINLIPNKQDRTLTIVDTGIGMTKADLINNLGTIAKSGTKAFMEALQAGADISMIGQFGVGFYSAYLVAEKVTVITKHNDDEQYAWESSAGGSFTVRTDTGEPMGRGTKVILHLKEDQTEYLEERRIKEIVKKHSQFIGYPITLFVEKERDKEVSDDEAEEKEDKEEEKEKEEKESEDKPEIEDVGSDEEEEKKDGDKKKKKKIKEKYIDQEELNKTKPIWTRNPDDITNEEYGEFYKSLTNDWEDHLAVKHFSVEGQLEFRALLFVPRRAPFDLFENRKKKNNIKLYVRRVFIMDNCEELIPEYLNFIRGVVDSEDLPLNISREMLQQSKILKVIRKNLVKKCLELFTELAEDKENYKKFYEQFSKNIKLGIHEDSQNRKKLSELLRYYTSASGDEMVSLKDYCTRMKENQKHIYYITGETKDQVANSAFVERLRKHGLEVIYMIEPIDEYCVQQLKEFEGKTLVSVTKEGLELPEDEEEKKKQEEKKTKFENLCKIMKDILEKKVEKVVVSNRLVTSPCCIVTSTYGWTANMERIMKAQALRDNSTMGYMAAKKHLEINPDHSIIETLRQKAEADKNDKSVKDLVILLYETALLSSGFSLEDPQTHANRIYRMIKLGLGIDEDDPTADDTSAAVTEEMPPLEGDDDTSRMEEVD

SEQ ID NO: 1414 - protein, 16 aa, Homo sapiens
EFADSLGIPFLETSAK

SEQ ID NO: 1415 - protein, 11 aa, Homo sapiens
LMEVMNHVLGK

SEQ ID NO: 1416 - protein, 11 aa, Homo sapiens
LQEENLVITPR

SEQ ID NO: 1417 - protein, 17 aa, Homo sapiens
AVTELGRPDAEYWNSQK

SEQ ID NO: 1418 - protein, 13 aa, Homo sapiens
IFVEESIYDEFVR

SEQ ID NO: 1419 - protein, 9 aa, Homo sapiens
ILDLIESGK

SEQ ID NO: 1420 - protein, 501 aa, Homo sapiens
MSSSGTPDLPVLLTDLKIQYTKIFINNEWHDSVSGKKFPVFNPATEEELCQVEEGDKEDVDKAVKAARQAFQIGSPWRTMDASERGRLLYKLADLIERDRLLLATMESMNGGKLYSNAYLNDLAGCIKTLRYCAGWADKIQGRTIPIDGNFFTYTRHEPIGVCGQIIPWNFPLVMLIWKIGPALSCGNTVVVKPAEQTPLTALHVASLIKEAGFPPGVVNIVPGYGPTAGAAISSHMDIDKVAFTGSTEVGKLIKEAAGKSNLKRVTLELGGKSPCIVLADADLDNAVEFAHHGVFYHQGQCCIAASRIFVEESIYDEFVRRSVERAKKYILGNPLTPGVTQGPQIDKEQYDKILDLIESGKKEGAKLECGGGPWGNKGYFVQPTVFSNVTDEMRIAKEEIFGPVQQIMKFKSLDDVIKRANNTFYGLSAGVFTKDIDKAITISSALQAGTVWVNCYGVVSAQCPFGGFKMSGNGRELGEYGFHEYTEVKTVTVKISQKNS

SEQ ID NO: 1421 - protein, 17 aa, Homo sapiens
ACANPAAGSVILLENLR

SEQ ID NO: 1422 - protein, 17 aa, Homo sapiens
ALESPERPFLAILGGAK

SEQ ID NO: 1423 - protein, 18 aa, Homo sapiens
ITLPVDFVTADKFDENAK

SEQ ID NO: 1424 - protein, 15 aa, Homo sapiens
LGDVYVNDAFGTAHR

SEQ ID NO: 1425 - protein, 417 aa, Homo sapiens
MSLSNKLTLDKLDVKGKRVVMRVDFNVPMKNNQITNNQRIKAAVPSIKFCLDNGAKSVVLMSHLGRPDGVPMPDKYSLEPVAVELKSLLGKDVLFLKDCVGPEVEKACANPAAGSVILLENLRFHVEEEGKGKDASGNKVKAEPAKIEAFRASLSKLGDVYVNDAFGTAHRAHSSMVGVNLPQKAGGFLMKKELNYFAKALESPERPFLAILGGAKVADKIQLINNMLDKVNEMIIGGGMAFTFLKVLNNMEIGTSLFDEEGAKIVKDLMSKAEKNGVKITLPVDFVTADKFDENAKTGQATVASGIPAGWMGLDCGPESSKKYAEAVTRAKQIVWNGPVGVFEWEAFARGTKALMDEVVKATSRGCITIIGGGDTATCCAKWNTEDKVSHVSTGGGASLELLEGKVLPGVDALSNI

SEQ ID NO: 1426 - protein, 23 aa, Homo sapiens
NDFQLIGIQDGYLSLLQDSGEVR

SEQ ID NO: 1427 - protein, 14 aa, Homo sapiens
AQIHDLVLVGGSTR

SEQ ID NO: 1428 - protein, 16 aa, Homo sapiens
ATAGDTHLGGEDFDNR

SEQ ID NO: 1429 - protein, 14 aa, Homo sapiens
AVITVPAYFNDSQR

SEQ ID NO: 1430 - protein, 27 aa, Homo sapiens
EIAEAYLGYPVTNAVITVPAYFNDSQR

SEQ ID NO: 1431 - protein, 10 aa, Homo sapiens
FEELCSDLFR

SEQ ID NO: 1432 - protein, 11 aa, Homo sapiens
FELSGIPPAPR

SEQ ID NO: 1433 - protein, 14 aa, Homo sapiens
HWPFQVINDGDKPK

SEQ ID NO: 1434 - protein, 9 aa, Homo sapiens
LLQDFFNGR

SEQ ID NO: 1435 - protein, 10 aa, Homo sapiens
LVNHFVEEFK

SEQ ID NO: 1436 - protein, 11 aa, Homo sapiens
LVNHFVEEFKR

SEQ ID NO: 1437 - protein, 15 aa, Homo sapiens
NQVALNPQNTVFDAK

SEQ ID NO: 1438 - protein, 24 aa, Homo sapiens
QTQIFTTYSDNQPGVLIQVYEGER

SEQ ID NO: 1439 - protein, 14 aa, Homo sapiens
GPGPPAAGAAPSPR

SEQ ID NO: 1440 - protein, 22 aa, Homo sapiens
VEPTQDISISDQLGGQDVPVFR

SEQ ID NO: 1441 - protein, 17 aa, Homo sapiens
SSEHENAYENVPEEEGK

SEQ ID NO: 1442 - protein, 114 aa, Homo sapiens
MSALSLLILGLLTAVPPASCQQGLGNLQPWMQGLIAVAVFLVLVAIAFAVNHFWCQEEPEPAHMILTVGNKADGVLVGTDGRYSSMAASFRSSEHENAYENVPEEEGKVRSTPM

SEQ ID NO: 1443 - protein, 11 aa, Homo sapiens
IQPDTIIQVWR

SEQ ID NO: 1444 - protein, 19 aa, Homo sapiens
EPAPPNGSAAEPPTEAASR

SEQ ID NO: 1445 - protein, 387 aa, Homo sapiens
MEVLAAETTSQQERLQAIAEKRKRQAEIENKRRQLEDERRQLQHLKSKALRERWLLEGTPSSASEGDEDLRRQMQDDEQKTRLLEDSVSRLEKEIEVLERGDSAPATAKENAAAPSPVRAPAPSPAKEERKTEVVMNSQQTPVGTPKDKRVSNTPLRTVDGSPMMKAAMYSVEITVEKDKVTGETRVLSSTTLLPRQPLPLGIKVYEDETKVVHAVDGTAENGIHPLSSSEVDELIHKADEVTLSEAGSTAGAAETRGAVEGAARTTPSRREITGVQAQPGEATSGPPGIQPGQEPPVTMIFMGYQNVEDEAETKKVLGLQDTITAELVVIEDAAEPKEPAPPNGSAAEPPTEAASREENQAGPEATTSDPQDLDMKKHRCKCCSIM

SEQ ID NO: 1446 - protein, 10 aa, Homo sapiens
FIAVEQEFFR

SEQ ID NO: 1447 - protein, 14 aa, Homo sapiens
IEQEYQAGPLELNR

SEQ ID NO: 1448 - protein, 1009 aa, Homo sapiens
MGQLCWLPLLAPLLLLRPPGVQSAGPIRAFVVPHSHMDVGWVYTVQESMRAYAANVYTSVVEELARGQQRRFIAVEQEFFRLWWDGVASDQQKYQVRQLLEEGRLEFVIGGQVMHDEAVTHLDDQILQLTEGHGFLYETFGIRPQFSWHVDPFGASATTPTLFALAGFNAHLGSRIDYDLKAAMQEARGLQFVWRGSPSLSERQEIFTHIMDQYSYCTPSHIPFSNRSGFYWNGVAVFPKPPQDGVYPNMSEPVTPANINLYAEALVANVKQRAAWFRTPHVLWPWGCDKQFFNASVQFANMDPLLDHINSHAAELGVSVQYATLGDYFRALHALNVTWRVRDHHDFLPYSTEPFQAWTGFYTSRSSLKGLARRASALLYAGESMFTRYLWPAPRGHLDPTWALQQLQQLRWAVSEVQHHDAITGTESPKVRDMYATHLASGMLGMRKLMASIVLDELQPQAPMAASSDAGPAGHFASVYNPLAWTVTTIVTLTVGFPGVRVTDEAGHPVPSQIQNSTETPSAYDLLILTTIPGLSYRHYNIRPTAGAQEGTQEPAATVASTLQFGRRLRRRTSHAGRYLVPVANDCYIVLLDQDTNLMHSIWERQSNRTVRVTQEFLEYHVNGDVKQGPISDNYLFTPGKAAVPAWEAVEMEIVAGQLVTEIRQYFYRNMTAQNYTYAIRSRLTHVPQGHDGELLCHRIEQEYQAGPLELNREAVLRTSTNLNSQQVIYSDNNGYQMQRRPYVSYVNNSIARNYYPMVQSAFMEDGKSRLVLLSERAHGISSQGNGQVEVMLHRRLWNNFDWDLGYNLTLNDTSVVHPVLWLLLGSWSLTTALRQRSALALQHRPVVLFGDLAGTAPKLPGPQQQEAVTLPPNLHLQILSIPGWRYSSNHTEHSQNLRKGHRGEAQADLRRVLLRLYHLYEVGEDPVLSQPVTVNLEAVLQALGSVVAVEERSLTGTWDLSMLHRWSWRTGPGRHRGDTTSPSRPPGGPIITVHPKEIRTFFIHFQQQ

SEQ ID NO: 1449 - protein, 14 aa, Homo sapiens
DLISNNEQLPMLGR

SEQ ID NO: 1450 - protein, 8 aa, Homo sapiens
RPGAPESK

SEQ ID NO: 1451 - protein, 10 aa, Homo sapiens
CGIAVAPVSR

SEQ ID NO: 1452 - protein, 17 aa, Homo sapiens
FRPSEPHFTLDGNSFYK

SEQ ID NO: 1453 - protein, 7 aa, Homo sapiens
ISLQWLR

SEQ ID NO: 1454 - protein, 14 aa, Homo sapiens
LGTFEVEDQIEAAR

SEQ ID NO: 1455 - protein, 12 aa, Homo sapiens
SFYSDESLQYPK

SEQ ID NO: 1456 - protein, 9 aa, Homo sapiens
VWNNDIYVK

SEQ ID NO: 1457 - protein, 11 aa, Homo sapiens
WEYYDSVYTER

SEQ ID NO: 1458 - protein, 15 aa, Homo sapiens
YMGLPTPEDNLDHYR

SEQ ID NO: 1459 - protein, 13 aa, Homo sapiens
FWYQMILPPHFDK

SEQ ID NO: 1460 - protein, 766 aa, Homo sapiens
MKTPWKVLLGLLGAAALVTIITVPVVLLNKGTDDATADSRKTYTLTDYLKNTYRLKLYSLRWISDHEYLYKQENNILVFNAEYGNSSVFLENSTFDEFGHSINDYSISPDGQFILLEYNYVKQWRHSYTASYDIYDLNKRQLITEERIPNNTQWVTWSPVGHKLAYVWNNDIYVKIEPNLPSYRITWTGKEDIIYNGITDWVYEEEVFSAYSALWWSPNGTFLAYAQFNDTEVPLIEYSFYSDESLQYPKTVRVPYPKAGAVNPTVKFFVVNTDSLSSVTNATSIQITAPASMLIGDHYLCDVTWATQERISLQWLRRIQNYSVMDICDYDESSGRWNCLVARQHIEMSTTGWVGRFRPSEPHFTLDGNSFYKIISNEEGYRHICYFQIDKKDCTFITKGTWEVIGIEALTSDYLYYISNEYKGMPGGRNLYKIQLSDYTKVTCLSCELNPERCQYYSVSFSKEAKYYQLRCSGPGLPLYTLHSSVNDKGLRVLEDNSALDKMLQNVQMPSKKLDFIILNETKFWYQMILPPHFDKSKKYPLLLDVYAGPCSQKADTVFRLNWATYLASTENIIVASFDGRGSGYQGDKIMHAINRRLGTFEVEDQIEAARQFSKMGFVDNKRIAIWGWSYGGYVTSMVLGSGSGVFKCGIAVAPVSRWEYYDSVYTERYMGLPTPEDNLDHYRNSTVMSRAENFKQVEYLLIHGTADDNVHFQQSAQISKALVDVGVDFQAMWYTDEDHGIASSTAHQHIYTHMSHFIKQCFSLP

SEQ ID NO: 1461 - protein, 21 aa, Homo sapiens
SLGLPENHIVFPVPIDQCIDG

SEQ ID NO: 1462 - protein, 15 aa, Homo sapiens
VPLQQNFQDNQFQGK

SEQ ID NO: 1463 - protein, 13 aa, Homo sapiens
WYVVGLAGNAILR

SEQ ID NO: 1464 - protein, 198 aa, Homo sapiens
MPLGLLWLGLALLGALHAQAQDSTSDLIPAPPLSKVPLQQNFQDNQFQGKWYVVGLAGNAILREDKDPQKMYATIYELKEDKSYNVTSVLFRKKKCDYWIRTFVPGCQPGEFTLGNIKSYPGLTSYLVRVVSTNYNQHAMVFFKKVSQNREYFKITLYGRTKELTSELKENFIRFSKSLGLPENHIVFPVPIDQCIDG

SEQ ID NO: 1465 - protein, 14 aa, Homo sapiens
SSAEMIENTNSLGK

SEQ ID NO: 1466 - protein, 1548 aa, Homo sapiens
MAEREVESGPRKRFEQKSGAVFDEIVENCGGIMDTEMSEDIDHNLTPTLDSMSYGMPNQTGSENSLLDEDDYFLNSGDLAGIPVVGSDNEDEQDFSSKDNLVSSIHTDDSLEVERRVTQHESDNENEIQIQNKLKKDFPKQFDQVSVFKSIRKDFSLVRENSKETFSGKEKNRDLTYEREKRLDKPHKDLDSRLKSSFFDKAANQVEETLHTHLPQTPETNFRDSSYPFANKESIGSELGNSFASNIRIKEEPLDDEYDKAMAPQQGLLDKIKDEPDNAQEYSHGQQQKTQEGELKISAVFSVSGSPLAPQLTTGFQPSLASSGMNKMLPSVPATAVRVSCSGCKKILQKGQTAYQRKGSTQLFCSTLCLTGYTVPPARPPPPLTKKTCSSCSKDILNPKDVISAQFENTTTSKDFCSQSCLSTYELKKKPIVTINTNSISTKCSMCQKNAVIRHEVNYQNVVHKLCSDACFSKFRSANNLTMNCCENCGGYCYSGSGQCHMLQIEGQSKKFCSSSCITAYKQKSAKITPCALCKSLRSSAEMIENTNSLGKTELFCSVNCLSAYRVKMVTSAGVQVQCNSCKTSAIPQYHLAMSDGSIRNFCSYSCVVAFQNLFNKPTGMNSSVVPLSQGQVIVSIPTGSTVSAGGGSTSAVSPTSISSSAAAGLQRLAAQSQHVGFARSVVKLKCQHCNRLFATKPELLDYKGKMFQFCGKNCSDEYKKINNVMAMCEYCKIEKIVKETVRFSGADKSFCSEGCKLLYKHDLAKRWGNHCKMCSYCLQTSPKLVQNNLGGKVEEFCCEECMSKYTVLFYQMAKCDACKRQGKLSESLKWRGEMKHFCNLLCILMFCNQQSVCDPPSQNNAANISMVQAASAGPPSLRKDSTPVIANVVSLASAPAAQPTVNSNSVLQGAVPTVTAKIIGDASTQTDALKLPPSQPPRLLKNKALLCKPITQTKATSCKPHTQNKECQTEDTPSQPQIIVVPVPVPVFVPIPLHLYTQYAPVPFGIPVPMPVPMLIPSSMDSEDKVTESIEDIKEKLPTHPFEADLLEMAEMIAEDEEKKTLSQGESQTSEHELFLDTKIFEKDQGSTYSGDLESEAVSTPHSWEEELNHYALKSNAVQEADSELKQFSKGETEQDLEADFPSDSFDPLNKGQGIQARSRTRRRHRDGFPQPRRRGRKKSIVAVEPRSLIQGAFQGCSVSGMTLKYMYGVNAWKNWVQWKNAKEEQGDLKCGGVEQASSSPRSDPLGSTQDHALSQESSEPGCRVRSIKLKEDILSCTFAELSLGLCQFIQEVRRPNGEKYDPDSILYLCLGIQQYLFENGRIDNIFTEPYSRFMIELTKLLKIWEPTILPNGYMFSRIEEEHLWECKQLGAYSPIVLLNTLLFFNTKYFQLKNVTEHLKLSFAHVMRRTRTLKYSTKMTYLRFFPPLQKQESEPDKLTVGKRKRNEDDEVPVGVEMAENTDNPLRCPVRLYEFYLSKCSESVKQRNDVFYLQPERSCVPNSPMWYSTFPIDPGTLDTMLTRILMVREVHEELAKAKSEDSDVELSD

SEQ ID NO: 1467 - protein, 14 aa, Homo sapiens
SMYETPSLEQDLER

SEQ ID NO: 1468 - protein, 19 aa, Homo sapiens
RQEEAALLSQEFAEAWGQK

SEQ ID NO: 1469 - protein, 1306 aa, Homo sapiens
MGAASGRRGPGLLLPLPLLLLLPPQPALALDPGLQPGNFSADEAGAQLFAQSYNSSAEQVLFQSVAASWAHDTNITAENARRQEEAALLSQEFAEAWGQKAKELYEPIWQNFTDPQLRRIIGAVRTLGSANLPLAKRQQYNALLSNMSRIYSTAKVCLPNKTATCWSLDPDLTNILASSRSYAMLLFAWEGWHNAAGIPLKPLYEDFTALSNEAYKQDGFTDTGAYWRSWYNSPTFEDDLEHLYQQLEPLYLNLHAFVRRALHRRYGDRYINLRGPIPAHLLGDMWAQSWENIYDMVVPFPDKPNLDVTSTMLQQGWNATHMFRVAEEFFTSLELSPMPPEFWEGSMLEKPADGREVVCHASAWDFYNRKDFRIKQCTRVTMDQLSTVHHEMGHIQYYLQYKDLPVSLRRGANPGFHEAIGDVLALSVSTPEHLHKIGLLDRVTNDTESDINYLLKMALEKIAFLPFGYLVDQWRWGVFSGRTPPSRYNFDWWYLRTKYQGICPPVTRNETHFDAGAKFHVPNVTPYIRYFVSFVLQFQFHEALCKEAGYEGPLHQCDIYRSTKAGAKLRKVLQAGSSRPWQEVLKDMVGLDALDAQPLLKYFQPVTQWLQEQNQQNGEVLGWPEYQWHPPLPDNYPEGIDLVTDEAEASKFVEEYDRTSQVVWNEYAEANWNYNTNITTETSKILLQKNMQIANHTLKYGTQARKFDVNQLQNTTIKRIIKKVQDLERAALPAQELEEYNKILLDMETTYSVATVCHPNGSCLQLEPDLTNVMATSRKYEDLLWAWEGWRDKAGRAILQFYPKYVELINQAARLNGYVDAGDSWRSMYETPSLEQDLERLFQELQPLYLNLHAYVRRALHRHYGAQHINLEGPIPAHLLGNMWAQTWSNIYDLVVPFPSAPSMDTTEAMLKQGWTPRRMFKEADDFFTSLGLLPVPPEFWNKSMLEKPTDGREVVCHASAWDFYNGKDFRIKQCTTVNLEDLVVAHHEMGHIQYFMQYKDLPVALREGANPGFHEAIGDVLALSVSTPKHLHSLNLLSSEGGSDEHDINFLMKMALDKIAFIPFSYLVDQWRWRVFDGSITKENYNQEWWSLRLKYQGLCPPVPRTQGDFDPGAKFHIPSSVPYIRYFVSFIIQFQFHEALCQAAGHTGPLHKCDIYQSKEAGQRLATAMKLGFSRPWPEAMQLITGQPNMSASAMLSYFKPLLDWLRTENELHGEKLGWPQYNWTPNSARSEGPLPDSGRVSFLGLDLDAQQARVGQWLLLFLGIALLVATLGLSQRLFSIRHRSLHRHSHGPQFGSEVELRHS

SEQ ID NO: 1470 - protein, 17 aa, Homo sapiens
CIARQVAAGMAYLSERK

SEQ ID NO: 1471 - protein, 869 aa, Homo sapiens
MRELVNIPLVHILTLVAFSGTEKLPKAPVITTPLETVDALVEEVATFMCAVESYPQPEISWTRNKILIKLFDTRYSIRENGQLLTILSVEDSDDGIYCCTANNGVGGAVESCGALQVKMKPKITRPPINVKIIEGLKAVLPCTTMGNPKPSVSWIKGDSPLRENSRIAVLESGSLRIHNVQKEDAGQYRCVAKNSLGTAYSKVVKLEVEVFARILRAPESHNVTFGSFVTLHCTATGIPVPTITWIENGNAVSSGSIQESVKDRVIDSRLQLFITKPGLYTCIATNKHGEKFSTAKAAATISIAEWSKPQKDNKGYCAQYRGEVCNAVLAKDALVFLNTSYADPEEAQELLVHTAWNELKVVSPVCRPAAEALLCNHIFQECSPGVVPTPIPICREYCLAVKELFCAKEWLVMEEKTHRGLYRSEMHLLSVPECSKLPSMHWDPTACARLPHLDYNKENLKTFPPMTSSKPSVDIPNLPSSSSSSFSVSPTYSMTVIISIMSSFAIFVLLTITTLYCCRRRKQWKNKKRESAAVTLTTLPSELLLDRLHPNPMYQRMPLLLNPKLLSLEYPRNNIEYVRDIGEGAFGRVFQARAPGLLPYEPFTMVAVKMLKEEASADMQADFQREAALMAEFDNPNIVKLLGVCAVGKPMCLLFEYMAYGDLNEFLRSMSPHTVCSLSHSDLSMRAQVSSPGPPPLSCAEQLCIARQVAAGMAYLSERKFVHRDLATRNCLVGENMVVKIADFGLSRNIYSADYYKANENDAIPIRWMPPESIFYNRYTTESDVWAYGVVLWEIFSYGLQPYYGMAHEEVIYYVRDGNILSCPENCPVELYNLMRLCWSKLPADRPSFTSIHRILERMCERAEGTVSV

SEQ ID NO: 1472 - protein, 24 aa, Homo sapiens
SSGAAPAPASASAPAPVPGGEAER

SEQ ID NO: 1473 - protein, 11 aa, Homo sapiens
MSQTRDLQGGK

SEQ ID NO: 1474 - protein, 147 aa, Homo sapiens
MSQTRDLQGGKAFGLLKAQQEERLDEINKQFLDDPKYSSDEDLPSKLEGFKEKYMEFDLNGNGDIDIMSLKRMLEKLGVPKTHLELKKLIGEVSSGSGETFSYPDFLRMMLGKRSAILKMILMYEEKAREKEKPTGPPAKKAISELP

SEQ ID NO: 1475 - protein, 13 aa, Homo sapiens
FHQLDIDDLQSIR

SEQ ID NO: 1476 - protein, 16 aa, Homo sapiens
GQAAVQQLQAEGLSPR

SEQ ID NO: 1477 - protein, 277 aa, Homo sapiens
MSSGIHVALVTGGNKGIGLAIVRDLCRLFSGDVVLTARDVTRGQAAVQQLQAEGLSPRFHQLDIDDLQSIRALRDFLRKEYGGLDVLVNNAGIAFKVADPTPFHIQAEVTMKTNFFGTRDVCTELLPLIKPQGRVVNVSSIMSVRALKSCSPELQQKFRSETITEEELVGLMNKFVEDTKKGVHQKEGWPSSAYGVTKIGVTVLSRIHARKLSEQRKGDKILLNACCPGWVRTDMAGPKATKSPEEGAETPVYLALLPPDAEGPHGQFVSEKRVEQW

SEQ ID NO: 1478 - protein, 26 aa, Homo sapiens
AQEAPGQAEPPAAAEVQGAGNENEPR

SEQ ID NO: 1479 - protein, 10 aa, Homo sapiens
EADKSHPEQR

SEQ ID NO: 1480 - protein, 12 aa, Homo sapiens
EALAEAALESPR

SEQ ID NO: 1481 - protein, 24 aa, Homo sapiens
EAPGQAEPPAAAEVQGAGNENEPR

SEQ ID NO: 1482 - protein, 18 aa, Homo sapiens
EPPAAAEVQGAGNENEPR

SEQ ID NO: 1483 - protein, 25 aa, Homo sapiens
QEAPGQAEPPAAAEVQGAGNENEPR

SEQ ID NO: 1484 - protein, 8 aa, Homo sapiens
SKPGQFIR

SEQ ID NO: 1485 - protein, 16 aa, Homo sapiens
VIPSQEHLNGPLPVPF

SEQ ID NO: 1486 - protein, 7 aa, Homo sapiens
ETDEFFK

SEQ ID NO: 1487 - protein, 14 aa, Homo sapiens
SVDPDSPAEASGLR

SEQ ID NO: 1488 - protein, 358 aa, Homo sapiens
MSADAAAGAPLPRLCCLEKGPNGYGFHLHGEKGKLGQYIRLVEPGSPAEKAGLLAGDRLVEVNGENVEKETHQQVVSRIRAALNAVRLLVVDPETDEQLQKLGVQVREELLRAQEAPGQAEPPAAAEVQGAGNENEPREADKSHPEQRELRPRLCTMKKGPSGYGFNLHSDKSKPGQFIRSVDPDSPAEASGLRAQDRIVEVNGVCMEGKQHGDVVSAIRAGGDETKLLVVDRETDEFFKKCRVIPSQEHLNGPLPVPFTNGEIQKENSREALAEAALESPRPALVRSASSDTSEELNSQDSPPKQDSTAPSSTSSSDPILDFNISLAMAKERAHQKRSSKRAPQMDWSKKNELFSNL

SEQ ID NO: 1489 - protein, 20 aa, Homo sapiens
EFVEEFIWPAIQSSALYEDR

SEQ ID NO: 1490 - protein, 13 aa, Homo sapiens
APNTPDILEIEFK

SEQ ID NO: 1491 - protein, 18 aa, Homo sapiens
AQLHVQGLLHEAGSTDDR

SEQ ID NO: 1492 - protein, 14 aa, Homo sapiens
SEEPEVPDQEGLQR

SEQ ID NO: 1493 - protein, 16 aa, Homo sapiens
CSGIASAAAAAVEAAR

SEQ ID NO: 1494 - protein, 297 aa, Homo sapiens
MDAEGLALLLPPVTLAALVDSWLREDCPGLNYAALVSGAGPSQAALWAKSPGVLAGQPFFDAIFTQLNCQVSWFLPEGSKLVPVARVAEVRGPAHCLLLGERVALNTLARCSGIASAAAAAVEAARGAGWTGHVAGTRKTTPGFRLVEKYGLLVGGAASHRYDLGGLVMVKDNHVVAAGGVEKAVRAARQAADFALKVEVECSSLQEAVQAAEAGADLVLLDNFKPEELHPTATVLKAQFPSVAVEASGGITLDNLPQFCGPHIDVISMGMLTQAAPALDFSLKLFAKEVAPVPKIH

SEQ ID NO: 1495 - protein, 12 aa, Homo sapiens
QLVALIPYGDQR

SEQ ID NO: 1496 - protein, 16 aa, Homo sapiens
AATPEVVFPWPPLCCR

SEQ ID NO: 1497 - protein, 258 aa, Homo sapiens
MASAAAAEAEKGSPVVVGLLVVGNIIILLSGLSLFAETIWVTADQYRVYPLMGVSGKDDVFAGAWIAIFCGFSFFMVASFGVGAALCRRRSMVLTYLVLMLIVYIFECASCITSYTHRDYMVSNPSLITKQMLTFYSADTDQGQELTRLWDRVMIEQECCGTSGPMDWVNFTSAFRAATPEVVFPWPPLCCRRTGNFIPLNEEGCRLGHMDYLFTKGCFEHIGHAIDSYTWGISWFGFAILMWTLPVMLIAMYFYTML

SEQ ID NO: 1498 - protein, 26 aa, Homo sapiens
EPPPAYEPPAPAPLPPPSAPSLQPSR

SEQ ID NO: 1499 - protein, 347 aa, Homo sapiens
MAQSRDGGNPFAEPSELDNPFQDPAVIQHRPSRQYATLDVYNPFETREPPPAYEPPAPAPLPPPSAPSLQPSRKLSPTEPKNYGSYSTQASAAAATAELLKKQEELNRKAEELDRRERELQHAALGGTATRQNNWPPLPSFCPVQPCFFQDISMEIPQEFQKTVSTMYYLWMCSTLALLLNFLACLASFCVETNNGAGFGLSILWVLLFTPCSFVCWYRPMYKAFRSDSSFNFFVFFFIFFVQDVLFVLQAIGIPGWGFSGWISALVVPKGNTAVSVLMLLVALLFTGIAVLGIVMLKRIHSLYRRTGASFQKAQQEFAAGVFSNPAVRTAAANAAAGAAENAFRAP

SEQ ID NO: 1500 - protein, 16 aa, Homo sapiens
EDPLLTPVPASENPFR

SEQ ID NO: 1501 - protein, 71 aa, Homo sapiens
MASNNTASIAQARKLVEQLKMEANIDRIKVSKAAADLMAYCEAHAKEDPLLTPVPASENPFREKKFFCAIL

SEQ ID NO: 1502 - protein, 17 aa, Homo sapiens
LENYPIPEPGPNEVLLR

SEQ ID NO: 1503 - protein, 357 aa, Homo sapiens
MAAAAKPNNLSLVVHGPGDLRLENYPIPEPGPNEVLLRMHSVGICGSDVHYWEYGRIGNFIVKKPMVLGHEASGTVEKVGSSVKHLKPGDRVAIEPGAPRENDEFCKMGRYNLSPSIFFCATPPDDGNLCRFYKHNAAFCYKLPDNVTFEEGALIEPLSVGIHACRRGGVTLGHKVLVCGAGPIGMVTLLVAKAMGAAQVVVTDLSATRLSKAKEIGADLVLQISKESPQEIARKVEGQLGCKPEVTIECTGAEASIQAGIYATRSGGNLVLVGLGSEMTTVPLLHAAIREVDIKGVFRYCNTWPVAISMLASKSVNVKPLVTHRFPLEKALEAFETFKKGLGLKIMLKCDPSDQNP

SEQ ID NO: 1504 - protein, 12 aa, Homo sapiens
ALLAGGPDEADR

SEQ ID NO: 1505 - protein, 465 aa, Homo sapiens
MEEEDEEARALLAGGPDEADRGAPAAPGALPALCDPSRLAHRLLVLLLMCFLGFGSYFCYDNPAALQTQVKRDMQVNTTKFMLLYAWYSWPNVVLCFFGGFLIDRVFGIRWGTIIFSCFVCIGQVVFALGGIFNAFWLMEFGRFVFGIGGESLAVAQNTYAVSWFKGKELNLVFGLQLSMARIGSTVNMNLMGWLYSKIEALLGSAGHTTLGITLMIGGVTCILSLICALALAYLDQRAERILHKEQGKTGEVIKLTDVKDFSLPLWLIFIICVCYYVAVFPFIGLGKVFFTEKFGFSSQAASAINSVVYVISAPMSPVFGLLVDKTGKNIIWVLCAVAATLVSHMMLAFTMWNPWIAMCLLGLSYSLLACALWPMVAFVVPEHQLGTAYGFMQSIQNLGLAIISIIAGMILDSRGYLFLEVFFIACVSLSLLSVVLLYLVNRAQGGNLNYSARQREEIKFSHTE

SEQ ID NO: 1506 - protein, 11 aa, Homo sapiens
VTEIWQEVMQR

SEQ ID NO: 1507 - protein, 13 aa, Homo sapiens
AVVVHAGEDDLGR

SEQ ID NO: 1508 - protein, 240 aa, Homo sapiens
MLALLCSCLLLAAGASDAWTGEDSAEPNSDSAEWIRDMYAKVTEIWQEVMQRRDDDGALHAACQVQPSATLDAAQPRVTGVVLFRQLAPRAKLDAFFALEGFPTEPNSSSRAIHVHQFGDLSQGCESTGPHYNPLAVPHPQHPGDFGNFAVRDGSLWRYRAGLAASLAGPHSIVGRAVVVHAGEDDLGRGGNQASVENGNAGRRLACCVVGVCGPGLWERQAREHSERKKRRRESECKAA

SEQ ID NO: 1509 - protein, 14 aa, Homo sapiens
NINDAWVCTNDMFR

SEQ ID NO: 1510 - protein, 127 aa, Homo sapiens
MGDKPIWEQIGSSFIQHYYQLFDNDRTQLGAIYIDASCLTWEGQQFQGKAAIVEKLSSLPFQKIQHSITAQDHQPTPDSCIISMVVGQLKADEDPIMGFHQMFLLKNINDAWVCTNDMFRLALHNFG

SEQ ID NO: 1511 - protein, 21 aa, Homo sapiens
EISEVFPDQFIHLGGDEVEFK

SEQ ID NO: 1512 - protein, 11 aa, Homo sapiens
LAPGTIVEVWK

SEQ ID NO: 1513 - protein, 10 aa, Homo sapiens
VLDIIATINK

SEQ ID NO: 1514 - protein, 12 aa, Homo sapiens
YLDLISYGQDWR

SEQ ID NO: 1515 - protein, 556 aa, Homo sapiens
MELCGLGLPRPPMLLALLLATLLAAMLALLTQVALVVQVAEAARAPSVSAKPGPALWPLPLSVKMTPNLLHLAPENFYISHSPNSTAGPSCTLLEEAFRRYHGYIFGFYKWHHEPAEFQAKTQVQQLLVSITLQSECDAFPNISSDESYTLLVKEPVAVLKANRVWGALRGLETFSQLVYQDSYGTFTINESTIIDSPRFSHRGILIDTSRHYLPVKIILKTLDAMAFNKFNVLHWHIVDDQSFPYQSITFPELSNKGSYSLSHVYTPNDVRMVIEYARLRGIRVLPEFDTPGHTLSWGKGQKDLLTPCYSRQNKLDSFGPINPTLNTTYSFLTTFFKEISEVFPDQFIHLGGDEVEFKCWESNPKIQDFMRQKGFGTDFKKLESFYIQKVLDIIATINKGSIVWQEVFDDKAKLAPGTIVEVWKDSAYPEELSRVTASGFPVILSAPWYLDLISYGQDWRKYYKVEPLDFGGTQKQKQLFIGGEACLWGEYVDATNLTPRLWPRASAVGERLWSSKDVRDMDDAYDRLTRHRCRMVERGIAAQPLYAGYCNHENM

SEQ ID NO: 1516 - protein, 9 aa, Homo sapiens
MLQHYLQNK

SEQ ID NO: 1517 - protein, 1749 aa, Homo sapiens
MAAAAGGPCVRSSRELWTILLGRSALRELSQIEAELNKHWRRLLEGLSYYKPPSPSSAEKVKANKDVASPLKELGLRISKFLGLDEEQSVQLLQCYLQEDYRGTRDSVKTVLQDERQSQALILKIADYYYEERTCILRCVLHLLTYFQDERHPYRVEYADCVDKLEKELVSKYRQQFEELYKTEAPTWETHGNLMTERQVSRWFVQCLREQSMLLEIIFLYYAYFEMAPSDLLVLTKMFKEQGFGSRQTNRHLVDETMDPFVDRIGYFSALILVEGMDIESLHKCALDDRRELHQFAQDGLICQDMDCLMLTFGDIPHHAPVLLAWALLRHTLNPEETSSVVRKIGGTAIQLNVFQYLTRLLQSLASGGNDCTTSTACMCVYGLLSFVLTSLELHTLGNQQDIIDTACEVLADPSLPELFWGTEPTSGLGIILDSVCGMFPHLLSPLLQLLRALVSGKSTAKKVYSFLDKMSFYNELYKHKPHDVISHEDGTLWRRQTPKLLYPLGGQTNLRIPQGTVGQVMLDDRAYLVRWEYSYSSWTLFTCEIEMLLHVVSTADVIQHCQRVKPIIDLVHKVISTDLSIADCLLPITSRIYMLLQRLTTVISPPVDVIASCVNCLTVLAARNPAKVWTDLRHTGFLPFVAHPVSSLSQMISAEGMNAGGYGNLLMNSEQPQGEYGVTIAFLRLITTLVKGQLGSTQSQGLVPCVMFVLKEMLPSYHKWRYNSHGVREQIGCLILELIHAILNLCHETDLHSSHTPSLQFLCICSLAYTEAGQTVINIMGIGVDTIDMVMAAQPRSDGAEGQGQGQLLIKTVKLAFSVTNNVIRLKPPSNVVSPLEQALSQHGAHGNNLIAVLAKYIYHKHDPALPRLAIQLLKRLATVAPMSVYACLGNDAAAIRDAFLTRLQSKIEDMRIKVMILEFLTVAVETQPGLIELFLNLEVKDGSDGSKEFSLGMWSCLHAVLELIDSQQQDRYWCPPLLHRAAIAFLHALWQDRRDSAMLVLRTKPKFWENLTSPLFGTLSPPSETSEPSILETCALIMKIICLEIYYVVKGSLDQSLKDTLKKFSIEKRFAYWSGYVKSLAVHVAETEGSSCTSLLEYQMLVSAWRMLLIIATTHADIMHLTDSVVRRQLFLDVLDGTKALLLVPASVNCLRLGSMKCTLLLILLRQWKRELGSVDEILGPLTEILEGVLQADQQLMEKTKAKVFSAFITVLQMKEMKVSDIPQYSQLVLNVCETLQEEVIALFDQTRHSLALGSATEDKDSMETDDCSRSRHRDQRDGVCVLGLHLAKELCEVDEDGDSWLQVTRRLPILPTLLTTLEVSLRMKQNLHFTEATLHLLLTLARTQQGATAVAGAGITQSICLPLLSVYQLSTNGTAQTPSASRKSLDAPSWPGVYRLSMSLMEQLLKTLRYNFLPEALDFVGVHQERTLQCLNAVRTVQSLACLEEADHTVGFILQLSNFMKEWHFHLPQLMRDIQVNLGYLCQACTSLLHSRKMLQHYLQNKNGDGLPSAVAQRVQRPPSAASAAPSSSKQPAADTEASEQQALHTVQYGLLKILSKTLAALRHFTPDVCQILLDQSLDLAEYNFLFALSFTTPTFDSEVAPSFGTLLATVNVALNMLGELDKKKEPLTQAVGLSTQAEGTRTLKSLLMFTMENCFYLLISQAMRYLRDPAVHPRDKQRMKQELSSELSTLLSSLSRYFRRGAPSSPATGVLPSPQGKSTSLSKASPESQEPLIQLVQAFVRHMQR

SEQ ID NO: 1518 - protein, 12 aa, Homo sapiens
GRPLAEESEQER

SEQ ID NO: 1519 - protein, 371 aa, Homo sapiens
MAWTKYQLFLAGLMLVTGSINTLSAKWADNFMAEGCGGSKEHSFQHPFLQAVGMFLGEFSCLAAFYLLRCRAAGQSDSSVDPQQPFNPLLFLPPALCDMTGTSLMYVALNMTSASSFQMLRGAVIIFTGLFSVAFLGRRLVLSQWLGILATIAGLVVVGLADLLSKHDSQHKLSEVITGDLLIIMAQIIVAIQMVLEEKFVYKHNVHPLRAVGTEGLFGFVILSLLLVPMYYIPAGSFSGNPRGTLEDALDAFCQVGQQPLIAVALLGNISSIAFFNFAGISVTKELSATTRMVLDSLRTVVIWALSLALGWEAFHALQILGFLILLIGTALYNGLHRPLLGRLSRGRPLAEESEQERLLGGTRTPINDAS

SEQ ID NO: 1520 - protein, 16 aa, Homo sapiens
EAAAAALPAAVPGPGR

SEQ ID NO: 1521 - protein, 17 aa, Homo sapiens
QPLLGPGLGPGLGASWR

SEQ ID NO: 1522 - protein, 478 aa, Homo sapiens
MGSRWSSEEERQPLLGPGLGPGLGASWRSREAAAAALPAAVPGPGRVYGRRWLVLLLFSLLAFVQGLVWNTWGPIQNSARQAYGFSSWDIALLVLWGPIGFLPCFAFMWLLDKRGLRITVLLTSFLMVLGTGLRCIPISDLILKRRLIHGGQMLNGLAGPTVMNAAPFLSTTWFSADERATATAIASMLSYLGGACAFLVGPLVVPAPNGTSPLLAAESSRAHIKDRIEAVLYAEFGVVCLIFSATLAYFPPRPPLPPSVAAASQRLSYRRSVCRLLSNFRFLMIALAYAIPLGVFAGWSGVLDLILTPAHVSQVDAGWIGFWSIVGGCVVGIAMARFADFIRGMLKLILLLLFSGATLSSTWFTLTCLNSITHLPLTTVTLYASCILLGVFLNSSVPIFFELFVETVYPVPEGITCGVVTFLSNMFMGVLLFFLTFYHTELSWFNWCLPGSCLLSLLLILCFRESYDRLYLDVVVSV

SEQ ID NO: 1523 - protein, 13 aa, Homo sapiens
SFPDFPTPGVVFR

SEQ ID NO: 1524 - protein, 134 aa, Homo sapiens
MADSELQLVEQRIRSFPDFPTPGVVFRDISPVLKDPASFRAAIGLLARHLKATHGGRIDYIAGLDSRGFLFGPSLAQELGLGCVLIRKRGKLPGPTLWASYSLEYGKAELEIQKDALEPGQRVVVVDDLLATGV

SEQ ID NO: 1525 - protein, 10 aa, Homo sapiens
IEDYFPEFAR

SEQ ID NO: 1526 - protein, 17 aa, Homo sapiens
SNLVPPVELANPENQFR

SEQ ID NO: 1527 - protein, 16 aa, Homo sapiens
YTTPEDATPEPGEDPR

SEQ ID NO: 1528 - protein, 9 aa, Homo sapiens
LQEALNLFK

SEQ ID NO: 1529 - protein, 1037 aa, Homo sapiens
MGVRNCLYGNNMSGQRDIPPEIGEQPEQPPLEAPGAAAPGAGPSPAEEMETEPPHNEPIPVENDGEACGPPEVSRPNFQVLNPAFREAGAHGSYSPPPEEAMPFEAEQPSLGGFWPTLEQPGFPSGVHAGLEAFGPALMEPGAFSGARPGLGGYSPPPEEAMPFEFDQPAQRGCSQLLLQVPDLAPGGPGAAGVPGAPPEEPQALRPAKAGSRGGYSPPPEETMPFELDGEGFGDDSPPPGLSRVIAQVDGSSQFAAVAASSAVRLTPAANAPPLWVPGAIGSPSQEAVRPPSNFTGSSPWMEISGPPFEIGSAPAGVDDTPVNMDSPPIALDGPPIKVSGAPDKRERAERPPVEEEAAEMEGAADAAEGGKVPSPGYGSPAAGAASADTAARAAPAAPADPDSGATPEDPDSGTAPADPDSGAFAADPDSGAAPAAPADPDSGAAPDAPADPDSGAAPDAPADPDAGAAPEAPAAPAAAETRAAHVAPAAPDAGAPTAPAASATRAAQVRRAASAAPASGARRKIHLRPPSPEIQAADPPTPRPTRASAWRGKSESSRGRRVYYDEGVASSDDDSSGDESDDGTSGCLRWFQHRRNRRRRKPQRNLLRNFLVQAFGGCFGRSESPQPKASRSLKVKKVPLAEKRRQMRKEALEKRAQKRAEKKRSKLIDKQLQDEKMGYMCTHRLLLLGAGESGKSTIVKQMRILHVNGFNGEGGEEDPQAARSNSDGEKATKVQDIKNNLKEAIETIVAAMSNLVPPVELANPENQFRVDYILSVMNVPDFDFPPEFYEHAKALWEDEGVRACYERSNEYQLIDCAQYFLDKIDVIKQADYVPSDQDLLRCRVLTSGIFETKFQVDKVNFHMFDVGGQRDERRKWIQCFNDVTAIIFVVASSSYNMVIREDNQTNRLQEALNLFKSIWNNRWLRTISVILFLNKQDLLAEKVLAGKSKIEDYFPEFARYTTPEDATPEPGEDPRVTRAKYFIRDEFLRISTASGDGRHYCYPHFTCAVDTENIRRVFNDCRDIIQRMHLRQYELL

SEQ ID NO: 1530 - protein, 20 aa, Homo sapiens
EESQLPGTGGPEDVLQPVQR

SEQ ID NO: 1531 - protein, 19 aa, Homo sapiens
EVIAEEEPPTVTEPLPENR

SEQ ID NO: 1532 - protein, 1684 aa, Homo sapiens
MLGTITITVGQRDSEDVSKRDSDKEMATKSAVVHDITDDGQEETPEIIEQIPSSESNLEELTQPTESQANDIGFKKVFKFVGFKFTVKKDKTEKPDTVQLLTVKKDEGEGAAGAGDHKDPSLGAGEAASKESEPKQSTEKPEETLKREQSHAEISPPAESGQAVEECKEEGEEKQEKEPSKSAESPTSPVTSETGSTFKKFFTQGWAGWRKKTSFRKPKEDEVEASEKKKEQEPEKVDTEEDGKAEVASEKLTASEQAHPQEPAESAHEPRLSAEYEKVELPSEEQVSGSQGPSEEKPAPLATEVFDEKIEVHQEEVVAEVHVSTVEERTEEQKTEVEETAGSVPAEELVEMDAEPQEAEPAKELVKLKETCVSGEDPTQGADLSPDEKVLSKPPEGVVSEVEMLSSQERMKVQGSPLKKLFTSTGLKKLSGKKQKGKRGGGDEESGEHTQVPADSPDSQEEQKGESSASSPEEPEEITCLEKGLAEVQQDGEAEEGATSDGEKKREGVTPWASFKKMVTPKKRVRRPSESDKEDELDKVKSATLSSTESTASEMQEEMKGSVEEPKPEEPKRKVDTSVSWEALICVGSSKKRARRGSSSDEEGGPKAMGGDHQKADEAGKDKETGTDGILAGSQEHDPGQGSSSPEQAGSPTEGEGVSTWESFKRLVTPRKKSKSKLEEKSEDSIAGSGVEHSTPDTEPGKEESWVSIKKFIPGRRKKRPDGKQEQAPVEDAGPTGANEDDSDVPAVVPLSEYDAVEREKMEAQQAQKSAEQPEQKAATEVSKELSESQVHMMAAAVADGTRAATIIEERSPSWISASVTEPLEQVEAEAALLTEEVLEREVIAEEEPPTVTEPLPENREARGDTVVSEAELTPEAVTAAETAGPLGAEEGTEASAAEETTEMVSAVSQLTDSPDTTEEATPVQEVEGGVPDIEEQERRTQEVLQAVAEKVKEESQLPGTGGPEDVLQPVQRAEAERPEEQAEASGLKKETDVVLKVDAQEAKTEPFTQGKVVGQTTPESFEKAPQVTESIESSELVTTCQAETLAGVKSQEMVMEQAIPPDSVETPTDSETDGSTPVADFDAPGTTQKDEIVEIHEENEVASGTQSGGTEAEAVPAQKERPPAPSSFVFQEETKEQSKMEDTLEHTDKEVSVETVSILSKTEGTQEADQYADEKTKDVPFFEGLEGSIDTGITVSREKVTEVALKGEGTEEAECKKDDALELQSHAKSPPSPVEREMVVQVEREKTEAEPTHVNEEKLEHETAVTVSEEVSKQLLQTVNVPIIDGAKEVSSLEGSPPPCLGQEEAVCTKIQVQSSEASFTLTAAAEEEKVLGETANILETGETLEPAGAHLVLEEKSSEKNEDFAAHPGEDAVPTGPDCQAKSTPVIVSATTKKGLSSDLEGEKTTSLKWKSDEVDEQVACQEVKVSVAIEDLEPENGILELETKSSKLVQNIIQTAVDQFVRTEETATEMLTSELQTQAHVIKADSQDAGQETEKEGEEPQASAQDETPITSAKEESESTAVGQAHSDISKDMSEASEKTMTVEVEGSTVNDQQLEEVVLPSEEEGGGAGTKSVPEDDGHALLAERIEKSLVEPKEDEKGDDVDDPENQNSALADTDASGGLTKESPDTNGPKQKEKEDAQEVELQEGKVHSESDKAITPQAQEELQKQERESAKSELTES

SEQ ID NO: 1533 - protein, 9 aa, Homo sapiens
WFYIASAFR

SEQ ID NO: 1534 - protein, 14 aa, Homo sapiens
EQLGEFYEALDCLR

SEQ ID NO: 1535 - protein, 15 aa, Homo sapiens
YVGGQEHFAHLLILR

SEQ ID NO: 1536 - protein, 12 aa, Homo sapiens
STDYGIFQINSR

SEQ ID NO: 1537 - protein, 148 aa, Homo sapiens
MKALIVLGLVLLSVTVQGKVFERCELARTLKRLGMDGYRGISLANWMCLAKWESGYNTRATNYNAGDRSTDYGIFQINSRYWCNDGKTPGAVNACHLSCSALLQDNIADAVACAKRVVRDPQGIRAWVAWRNRCQNRDVRQYVQGCGV

SEQ ID NO: 1538 - protein, 19 aa, Homo sapiens
FLEGEVPLETFLENFSSMR

SEQ ID NO: 1539 - protein, 12 aa, Homo sapiens
NLEFQGPLEISR

SEQ ID NO: 1540 - protein, 32 aa, Homo sapiens
TLQELEELQNDSEAIDQLALESPEVQDLQLER

SEQ ID NO: 1541 - protein, 355 aa, Homo sapiens
METLKDKTLQELEELQNDSEAIDQLALESPEVQDLQLEREMALATNRSLAERNLEFQGPLEISRSNLSDRYQELRKLVERCQEQKAKLEKFSSALQPGTLLDLLQVEGMKIEEESEAMAEKFLEGEVPLETFLENFSSMRMLSHLRRVRVEKLQEVVRKPRASQELAGDAPPPRPPPPVRPVPQGTPPVVEEQPQPPLAMPPYPLPYSPSPSLPVGPTAHGALPPAPFPVVSQPSFYSGPLGPTYPAAQLGPRGAAGYSWSPQRSMPPRPGYPGTPMGASGPGYPLRGGRAPSPGYPQQSPYPATGGKPPYPIQPQLPSFPGQPQPSVPLQPPYPPGPAPPYGFPPPPGPAWPGY

SEQ ID NO: 1542 - protein, 18 aa, Homo sapiens
VLAPQISFAPEIASEEER

SEQ ID NO: 1543 - protein, 231 aa, Homo sapiens
MAGKKVLIVYAHQEPKSFNGSLKNVAVDELSRQGCTVTVSDLYAMNLEPRATDKDITGTLSNPEVFNYGVETHEAYKQRSLASDITDEQKKVREADLVIFQFPLYWFSVPAILKGWMDRVLCQGFAFDIPGFYDSGLLQGKLALLSVTTGGTAEMYTKTGVNGDSRYFLWPLQHGTLHFCGFKVLAPQISFAPEIASEEERKGMVAAWSQRLQTIWKEEPIPCTAHWHFGQ

SEQ ID NO: 1544 - protein, 12 aa, Homo sapiens
VHVGDEDFVHLR

SEQ ID NO: 1545 - protein, 98 aa, Homo sapiens
MMCGAPSATQPATAETQHIADQVRSQLEEKENKKFPVFKAVSFKSQVVAGTNYFIKVHVGDEDFVHLRVFQSLPHENKPLTLSNYQTNKAKHDELTYF

SEQ ID NO: 1546 - protein, 13 aa, Homo sapiens
TATPQQAQEVHEK

SEQ ID NO: 1547 - protein, 249 aa, Homo sapiens
MAPSRKFFVGGNWKMNGRKQSLGELIGTLNAAKVPADTEVVCAPPTAYIDFARQKLDPKIAVAAQNCYKVTNGAFTGEISPGMIKDCGATWVVLGHSERRHVFGESDELIGQKVAHALAEGLGVIACIGEKLDEREAGITEKVVFEQTKVIADNVKDWSKVVLAYEPVWAIGTGKTATPQQAQEVHEKLRGWLKSNVSDAVAQSTRIIYGGSVTGATCKELASQPDVDGFLVGGASLKPEFVDIINAKQ

SEQ ID NO: 1548 - protein, 18 aa, Homo sapiens
LGADAVGMSTVPEVIVAR

SEQ ID NO: 1549 - protein, 17 aa, Homo sapiens
LTQAQIFDYGEIPNFPR

SEQ ID NO: 1550 - protein, 15 aa, Homo sapiens
DHINLPGFSGQNPLR

SEQ ID NO: 1551 - protein, 10 aa, Homo sapiens
FEVGDIMLIR

SEQ ID NO: 1552 - protein, 289 aa, Homo sapiens
MENGYTYEDYKNTAEWLLSHTKHRPQVAIICGSGLGGLTDKLTQAQIFDYGEIPNFPRSTVPGHAGRLVFGFLNGRACVMMQGRFHMYEGYPLWKVTFPVRVFHLLGVDTLVVTNAAGGLNPKFEVGDIMLIRDHINLPGFSGQNPLRGPNDERFGDRFPAMSDAYDRTMRQRALSTWKQMGEQRELQEGTYVMVAGPSFETVAECRVLQKLGADAVGMSTVPEVIVARHCGLRVFGFSLITNKVIMDYESLEKANHEEVLAAGKQAAQKLEQFVSILMASIPLPDKAS

SEQ ID NO: 1553 - protein, 10 aa, Homo sapiens
IIHGQDFDQR

SEQ ID NO: 1554 - protein, 17 aa, Homo sapiens
LGEPDYIPSQQDILLAR

SEQ ID NO: 1555 - protein, 15 aa, Homo sapiens
LTESLNIFETIVNNR

SEQ ID NO: 1556 - protein, 10 aa, Homo sapiens
VFLQYLPAIR

SEQ ID NO: 1557 - protein, 377 aa, Homo sapiens
MADFLPSRSVLSVCFPGCLLTSGEAEQQRKSKEIDKCLSREKTYVKRLVKILLLGAGESGKSTFLKQMRIIHGQDFDQRAREEFRPTIYSNVIKGMRVLVDAREKLHIPWGDNSNQQHGDKMMSFDTRAPMAAQGMVETRVFLQYLPAIRALWADSGIQNAYDRRREFQLGESVKYFLDNLDKLGEPDYIPSQQDILLARRPTKGIHEYDFEIKNVPFKMVDVGGQRSERKRWFECFDSVTSILFLVSSSEFDQVLMEDRLTNRLTESLNIFETIVNNRVFSNVSIILFLNKTDLLEEKVQIVSIKDYFLEFEGDPHCLRDVQKFLVECFRNKRRDQQQKPLYHHFTTAINTENIRLVFRDVKDTILHDNLKQLMLQ

SEQ ID NO: 1558 - protein, 20 aa, Homo sapiens
EALTDADDFGLQFPLDLDVR

SEQ ID NO: 1559 - protein, 295 aa, Homo sapiens
MAGYLPPKGYAPSPPPPYPVTPGYPEPALHPGPGQAPVPAQVPAPAPGFALFPSPGPVALGSAAPFLPLPGVPSGLEFLVQIDQILIHQKAERVETFLGWETCNRYELRSGAGQPLGQAAEESNCCARLCCGARRPLRVRLADPGDREVLRLLRPLHCGCSCCPCGLQEMEVQAPPGTTIGHVLQTWHPFLPKFSIQDADRQTVLRVVGPCWTCGCGTDTNFEVKTRDESRSVGRISKQWGGLVREALTDADDFGLQFPLDLDVRVKAVLLGATFLIDYMFFEKRGGAGPSAVTS

SEQ ID NO: 1560 - protein, 11 aa, Homo sapiens
LALLVDTVGPR

SEQ ID NO: 1561 - protein, 472 aa, Homo sapiens
MKFLIFAFFGGVHLLSLCSGKAICKNGISKRTFEEIKEEIASCGDVAKAIINLAVYGKAQNRSYERLALLVDTVGPRLSGSKNLEKAIQIMYQNLQQDGLEKVHLEPVRIPHWERGEESAVMLEPRIHKIAILGLGSSIGTPPEGITAEVLVVTSFDELQRRASEARGKIVVYNQPYINYSRTVQYRTQGAVEAAKVGALASLIRSVASFSIYSPHTGIQEYQDGVPKIPTACITVEDAEMMSRMASHGIKIVIQLKMGAKTYPDTDSFNTVAEITGSKYPEQVVLVSGHLDSWDVGQGAMDDGGGAFISWEALSLIKDLGLRPKRTLRLVLWTAEEQGGVGAFQYYQLHKVNISNYSLVMESDAGTFLPTGLQFTGSEKARAIMEEVMSLLQPLNITQVLSHGEGTDINFWIQAGVPGASLLDDLYKYFFFHHSHGDTMTVMDPKQMNVAAAVWAVVSYVVADMEEMLPRS

SEQ ID NO: 1562 - protein, 19 aa, Homo sapiens
SLFWENSHLLVNSFADNTR

SEQ ID NO: 1563 - protein, 16 aa, Homo sapiens
GIENLAFVPSSPDILR

SEQ ID NO: 1564 - protein, 724 aa, Homo sapiens
MKSAKGIENLAFVPSSPDILRRLSASPSQIEVSALSSDPQRENSQPQELQKPQEPQKSPEPSLPSAPPNVSEEKLRSLSLSEFEEGSYGWRNFHPQCLQRCNTPGGFLLHYCLLAVTQGIVVNGLVNISISTVEKRYEMKSSLTGLISSSYDISFCLLSLFVSFFGERGHKPRWLAFAAFMIGLGALVFSLPQFFSGEYKLGSLFEDTCVTTRNSTSCTSSTSSLSNYLYVFILGQLLLGAGGTPLYTLGTAFLDDSVPTHKSSLYIGTGYAMSILGPAIGYVLGGQLLTIYIDVAMGESTDVTEDDPRWLGAWWIGFLLSWIFAWSLIIPFSCFPKHLPGTAEIQAGKTSQAHQSNSNADVKFGKSIKDFPAALKNLMKNAVFMCLVLSTSSEALITTGFATFLPKFIENQFGLTSSFAATLGGAVLIPGAALGQILGGFLVSKFRMTCKNTMKFALFTSGVALTLSFVFMYAKCENEPFAGVSESYNGTGELGNLIAPCNANCNCSRSYYYPVCGDGVQYFSPCFAGCSNPVAHRKPKVYYNCSCIERKTEITSTAETFGFEAKAGKCETHCAKLPIFLCIFFIVIIFTFMAGTPITVSILRCVNHRQRSLALGIQFMVLRLLGTIPGPIIFGFTIDSTCILWDINDCGIKGACWIYDNIKMAHMLVAISVTCKVITMFFNGFAIFLYKPPPSATDVSFHKENAVVTNVLAEQDLNKIVKEG

SEQ ID NO: 1565 - protein, 9 aa, Homo sapiens
QVTVLELFR

SEQ ID NO: 1566 - protein, 520 aa, Homo sapiens
MEFHNGGHVSGIGGFLVSLTSRMKPHTLAVTPALIFAITVATIGSFQFGYNTGVINAPETIIKEFINKTLTDKANAPPSEVLLTNLWSLSVAIFSVGGMIGSFSVGLFVNRFGRRNSMLIVNLLAATGGCLMGLCKIAESVEMLILGRLVIGLFCGLCTGFVPMYIGEISPTALRGAFGTLNQLGIVIGILVAQIFGLELILGSEELWPVLLGFTILPAILQSAALPCCPESPRFLLINRKKEENATRILQRLWGTQDVSQDIQEMKDESARMSQEKQVTVLELFRVSSYRQPIIISIVLQLSQQLSGINAVFYYSTGIFKDAGVQQPIYATISAGVVNTIFTLLSLFLVERAGRRTLHMIGLGGMAFCSTLMTVSLLLKNHYNGMSFVCIGAILVFVACFEIGPGPIPWFIVAELFSQGPRPAAMAVAGCSNWTSNFLVGLLFPSAAYYLGAYVFIIFTGFLITFLAFTFFKVPETRGRTFEDITRAFEGQAHGADRSGKDGVMGMNSIEPAKETTTNV

SEQ ID NO: 1567 - protein, 11 aa, Homo sapiens
ESNGQPENNYK

SEQ ID NO: 1568 - protein, 22 aa, Homo sapiens
GFYPSDIAVEWESNGQPENNYK

SEQ ID NO: 1569 - protein, 10 aa, Homo sapiens
NQVSLTCLVK

SEQ ID NO: 1570 - protein, 17 aa, Homo sapiens
TTPPMLDSDGSFFLYSK

SEQ ID NO: 1571 - protein, 18 aa, Homo sapiens
VNPDTGYINYDQLEENAR

SEQ ID NO: 1572 - protein, 16 aa, Homo sapiens
IINAFFPEGEDQVNFR

SEQ ID NO: 1573 - protein, 195 aa, Homo sapiens
MGSRASTLLRDEELEEIKKETGFSHSQITRLYSRFTSLDKGENGTLSREDFQRIPELAINPLGDRIINAFFPEGEDQVNFRGFMRTLAHFRPIEDNEKSKDVNGPEPLNSRSNKLHFAFRLYDLDKDEKISRDELLQVLRMMVGVNISDEQLGSIADRTIQEADQDGDSAISFTEFVKVLEKVDVEQKMSIRFLH

SEQ ID NO: 1574 - protein, 14 aa, Homo sapiens
GEYVLLEAALTDLR

SEQ ID NO: 1575 - protein, 822 aa, Homo sapiens
MKPALLPWALLLLATALGPGPGPTADAQESCSMRCGALDGPCSCHPTCSGLGTCCLDFRDFCLEILPYSGSMMGGKDFVVRHFKMSSPTDASVICRFKDSIQTLGHVDSSGQVHCVSPLLYESGRIPFTVSLDNGHSFPRAGTWLAVHPNKVSMMEKSELVNETRWQYYGTANTSGNLSLTWHVKSLPTQTITIELWGYEETGMPYSQEWTAKWSYLYPLATHIPNSGSFTFTPKPAPPSYQRWRVGALRIIDSKNYAGQKDVQALWTNDHALAWHLSDDFREDPVAWARTQCQAWEELEDQLPNFLEELPDCPCTLTQARADSGRFFTDYGCDMEQGSVCTYHPGAVHCVRSVQASLRYGSGQQCCYTADGTQLLTADSSGGSTPDRGHDWGAPPFRTPPRVPSMSHWLYDVLSFYYCCLWAPDCPRYMQRRPSNDCRNYRPPRLASAFGDPHFVTFDGTNFTFNGRGEYVLLEAALTDLRVQARAQPGTMSNGTETRGTGLTAVAVQEGNSDVVEVRLANRTGGLEVLLNQEVLSFTEQSWMDLKGMFLSVAAGDRVSIMLASGAGLEVSVQGPFLSVSVLLPEKFLTHTHGLLGTLNNDPTDDFTLHSGRVLPPGTSPQELFLFGANWTVHNASSLLTYDSWFLVHNFLYQPKHDPTFEPLFPSETTLNPSLAQEAAKLCGDDHFCNFDVAATGSLSTGTATRVAHQLHQRRMQSLQPVVSCGWLAPPPNGQKEGNRYLAGSTIYFHCDNGYSLAGAETSTCQADGTWSSPTPKCQPGRSYAVLLGIIFGGLAVVAAVALVYVLLRRRKGNTHVWGAQP

SEQ ID NO: 1576 - protein, 19 aa, Homo sapiens
NVSAGTQDVPSPPSDYVER

SEQ ID NO: 1577 - protein, 21 aa, Homo sapiens
STPVPEVVQELPLTSPVDDFR

SEQ ID NO: 1578 - protein, 522 aa, Homo sapiens
MSSRPLESPPPYRPDEFKPNHYAPSNDIYGGEMHVRPMLSQPAYSFYPEDEILHFYKWTSPPGVIRILSMLIIVMCIAIFACVASTLAWDRGYGTSLLGGSVGYPYGGSGFGSYGSGYGYGYGYGYGYGGYTDPRAAKGFMLAMAAFCFIAALVIFVTSVIRSEMSRTRRYYLSVIIVSAILGIMVFIATIVYIMGVNPTAQSSGSLYGSQIYALCNQFYTPAATGLYVDQYLYHYCVVDPQEAIAIVLGFMIIVAFALIIFFAVKTRRKMDRYDKSNILWDKEHIYDEQPPNVEEWVKNVSAGTQDVPSPPSDYVERVDSPMAYSSNGKVNDKRFYPESSYKSTPVPEVVQELPLTSPVDDFRQPRYSSGGNFETPSKRAPAKGRAGRSKRTEQDHYETDYTTGGESCDELEEDWIREYPPITSDQQRQLYKRNFDTGLQEYKSLQSELDEINKELSRLDKELDDYREESEEYMAAADEYNRLKQVKGSADYKSKKNHCKQLKSKLSHIKKMVGDYDRQKT

SEQ ID NO: 1579 - protein, 20 aa, Homo sapiens
QFYDQALQQAVVDDDANNAK

SEQ ID NO: 1580 - protein, 20 aa, Homo sapiens
QFYDQALQQAVVDDDANNAK

SEQ ID NO: 1581 - protein, 19 aa, Homo sapiens
FVSPLTLVADEGWFITENR

SEQ ID NO: 1582 - protein, 11 aa, Homo sapiens
GIFLAFGPDFK

SEQ ID NO: 1583 - protein, 15 aa, Homo sapiens
IDVEGHHYGPASPQR

SEQ ID NO: 1584 - protein, 10 aa, Homo sapiens
LLVFLLDGFR

SEQ ID NO: 1585 - protein, 20 aa, Homo sapiens
NVPTDINFANAVSDALDSFK

SEQ ID NO: 1586 - protein, 11 aa, Homo sapiens
YISLNDLQQVK

SEQ ID NO: 1587 - protein, 13 aa, Homo sapiens
GWHGYDNELMDMR

SEQ ID NO: 1588 - protein, 7 aa, Homo sapiens
AFGPDFK

SEQ ID NO: 1589 - protein, 440 aa, Homo sapiens
MAVKLGTLLLALALGLAQPASARRKLLVFLLDGFRSDYISDEALESLPGFKEIVSRGVKVDYLTPDFPSLSYPNYYTLMTGRHCEVHQMIGNYMWDPTTNKSFDIGVNKDSLMPLWWNGSEPLWVTLTKAKRKVYMYYWPGCEVEILGVRPTYCLEYKNVPTDINFANAVSDALDSFKSGRADLAAIYHERIDVEGHHYGPASPQRKDALKAVDTVLKYMTKWIQERGLQDRLNVIIFSDHGMTDIFWMDKVIELNKYISLNDLQQVKDRGPVVSLWPAPGKHSEIYNKLSTVEHMTVYEKEAIPSRFYYKKGKFVSPLTLVADEGWFITENREMLPFWMNSTGRREGWQRGWHGYDNELMDMRGIFLAFGPDFKSNFRAAPIRSVDVYNVMCNVVGITPLPNNGSWSRVMCMLKGRASTAPPVWPSHCALALILLFLLA

SEQ ID NO: 1590 - protein, 19 aa, Homo sapiens
GGVGSPPPLTQEEAAAAAR

SEQ ID NO: 1591 - protein, 672 aa, Homo sapiens
MEEHTEAGSAPEMGAQKALIDNPADILVIAAYFLLVIGVGLWSMCRTNRGTVGGYFLAGRSMVWWPVGASLFASNIGSGHFVGLAGTGAASGLAVAGFEWNALFVVLLLGWLFAPVYLTAGVITMPQYLRKRFGGRRIRLYLSVLSLFLYIFTKISVDMFSGAVFIQQALGWNIYASVIALLGITMIYTVTGGLAALMYTDTVQTFVILGGACILMGYAFHEVGGYSGLFDKYLGAATSLTVSEDPAVGNISSFCYRPRPDSYHLLRHPVTGDLPWPALLLGLTIVSGWYWCSDQVIVQRCLAGKSLTHIKAGCILCGYLKLTPMFLMVMPGMISRILYPDEVACVVPEVCRRVCGTEVGCSNIAYPRLVVKLMPNGLRGLMLAVMLAALMSSLASIFNSSSTLFTMDIYTRLRPRAGDRELLLVGRLWVVFIVVVSVAWLPVVQAAQGGQLFDYIQAVSSYLAPPVSAVFVLALFVPRVNEQGAFWGLIGGLLMGLARLIPEFSFGSGSCVQPSACPAFLCGVHYLYFAIVLFFCSGLLTLTVSLCTAPIPRKHLHRLVFSLRHSKEEREDLDADEQQGSSLPVQNGCPESAMEMNEPQAPAPSLFRQCLLWFCGMSRGGVGSPPPLTQEEAAAAARRLEDISEDPSWARVVNLNALLMMAVAVFLWGFYA

SEQ ID NO: 1592 - protein, 18 aa, Homo sapiens
EYLNETVTEVWIEDPYIR

SEQ ID NO: 1593 - protein, 249 aa, Homo sapiens
MAKSGLRQDPQSTAAATVLKRAVELDSESRYPQALVCYQEGIDLLLQVLKGTKDNTKRCNLREKISKYMDRAENIKKYLDQEKEDGKYHKQIKIEENATGFSYESLFREYLNETVTEVWIEDPYIRHTHQLYNFLRFCEMLIKRPCKVKTIHLLTSLDEGIEQVQQSRGLQEIEESLRSHGVLLEVQYSSSIHDREIRFNNGWMIKIGRGLDYFKKPQSRFSLGYCDFDLRPCHETTVDIFHKKHTKNI

SEQ ID NO: 1594 - protein, 21 aa, Homo sapiens
GDEDQEEETQGQEEGDEGEPR

SEQ ID NO: 1595 - protein, 23 aa, Homo sapiens
GPGDEDQEEETQGQEEGDEGEPR

SEQ ID NO: 1596 - protein, 350 aa, Homo sapiens [sequence omitted]

SEQ ID NO: 1597 - protein, 13 aa, Homo sapiens
LNRQIRQHCLAFR

SEQ ID NO: 1598 - protein, 18 aa, Homo sapiens
IIQEQDAGLDALSSIISR

SEQ ID NO: 1599 - protein, 236 aa, Homo sapiens
MAPDPWFSTYDSTCQIAQEIAEKIQQRNQYERKGEKAPKLTVTIRALLQNLKEKIALLKDLLLRAVSTHQITQLEGDRRQNLLDDLVTRERLLLASFKNEGAEPDLIRSSLMSEEAKRGAPNPWLFEEPEETRGLGFDEIRQQQQKIIQEQDAGLDALSSIISRQKQMGQEIGNELDEQNEIIDDLANLVENTDEKLRNETRRVNMVDRKSASCGMIMVILLLLVAIVVVAVWPTN

SEQ ID NO: 1600 - protein, 8 aa, Homo sapiens
YSDFEWLR

SEQ ID NO: 1601 - protein, 162 aa, Homo sapiens
MAETVADTRRLITKPQNLNDAYGPPSNFLEIDVSNPQTVGVGRGRFTTYEIRVKTNLPIFKLKESTVRRRYSDFEWLRSELERESKVVVPPLPGKAFLRQLPFRGDDGIFDDNFIEERKQGLEQFINKVAGHPLAQNERCLHMFLQDEIIDKSYTPSKIRHA

SEQ ID NO: 1602 - protein, 10 aa, Homo sapiens
DEFLIQASPR

SEQ ID NO: 1603 - protein, 13 aa, Homo sapiens
DPENFPFVVLGNK

SEQ ID NO: 1604 - protein, 14 aa, Homo sapiens
EAINVEQAFQTIAR

SEQ ID NO: 1605 - protein, 10 aa, Homo sapiens
FQSLGVAFYR

SEQ ID NO: 1606 - protein, 14 aa, Homo sapiens
LVTMQIWDTAGQER

SEQ ID NO: 1607 - protein, 16 aa, Homo sapiens
QETEVELYNEFPEPIK

SEQ ID NO: 1608 - protein, 16 aa, Homo sapiens
TLDSWRDEFLIQASPR

SEQ ID NO: 1609 - protein, 6 aa, Homo sapiens
FSNQYK

SEQ ID NO: 1610 - protein, 11 aa, Homo sapiens
NNIPYFETSAK

SEQ ID NO: 1611 - protein, 207 aa, Homo sapiens
MTSRKKVLLKVIILGDSGVGKTSLMNQYVNKKFSNQYKATIGADFLTKEVMVDDRLVTMQIWDTAGQERFQSLGVAFYRGADCCVLVFDVTAPNTFKTLDSWRDEFLIQASPRDPENFPFVVLGNKIDLENRQVATKRAQAWCYSKNNIPYFETSAKEAINVEQAFQTIARNALKQETEVELYNEFPEPIKLDKNDRAKASAESCSC

SEQ ID NO: 1612 - protein, 26 aa, Homo sapiens
FGLNTVLTTDNSDLFINSIGIVPSVR

SEQ ID NO: 1613 - protein, 11 aa, Homo sapiens
FLNEMIAPVMR

SEQ ID NO: 1614 - protein, 11 aa, Homo sapiens
MHMWVEDVLDK

SEQ ID NO: 1615 - protein, 15 aa, Homo sapiens
SDFYDIVLVATPLNR

SEQ ID NO: 1616 - protein, 17 aa, Homo sapiens
MIPCDFLIPVQTQHPIR

SEQ ID NO: 1617 - protein, 558 aa, Homo sapiens
MAALTRDPQFQKLQQWYREHRSELNLRRLFDANKDRFNHFSLTLNTNHGHILVDYSKNLVTEDVMRMLVDLAKSRGVEAARERMFNGEKINYTEGRAVLHVALRNRSNTPILVDGKDVMPEVNKVLDKMKSFCQRVRSGDWKGYTGKTITDVINIGIGGSDLGPLMVTEALKPYSSGGPRVWYVSNIDGTHIAKTLAQLNPESSLFIIASKTFTTQETITNAETAKEWFLQAAKDPSAVAKHFVALSTNTTKVKEFGIDPQNMFEFWDWVGGRYSLWSAIGLSIALHVGFDNFEQLLSGAHWMDQHFRTTPLEKNAPVLLALLGIWYINCFGCETHAMLPYDQYLHRFAAYFQQGDMESNGKYITKSGTRVDHQTGPIVWGEPGTNGQHAFYQLIHQGTKMIPCDFLIPVQTQHPIRKGLHHKILLANFLAQTEALMRGKSTEEARKELQAAGKSPEDLERLLPHKVFEGNRPTNSIVFTKLTPFMLGALVAMYEHKIFVQGIIWDINSFDQWGVELGKQLAKKIEPELDGSAQVTSHDASTNGLINFIKQQREARVQ

SEQ ID NO: 1618 - protein, 14 aa, Homo sapiens
AGATLDLLVENMGR

SEQ ID NO: 1619 - protein, 15 aa, Homo sapiens
AYVAVDGIPQGVLER

SEQ ID NO: 1620 - protein, 12 aa, Homo sapiens
GQVWINGFNLGR

SEQ ID NO: 1621 - protein, 16 aa, Homo sapiens
LAHELGLLVILRPGPY

SEQ ID NO: 1622 - protein, 14 aa, Homo sapiens
TEAVASSLYDILAR

SEQ ID NO: 1623 - protein, 16 aa, Homo sapiens
TVGAALDILCPSGPIK

SEQ ID NO: 1624 - protein, 13 aa, Homo sapiens
VAVDGIPQGVLER

SEQ ID NO: 1625 - protein, 8 aa, Homo sapiens
WLGVLLPK

SEQ ID NO: 1626 - protein, 10 aa, Homo sapiens
HHLGDDVVLF

SEQ ID NO: 1627 - protein, 8 aa, Homo sapiens
ACDFDYLR

SEQ ID NO: 1628 - protein, 11 aa, Homo sapiens
VNYGAYINDFK

SEQ ID NO: 1629 - protein, 12 aa, Homo sapiens
LAHELGLLVILR

SEQ ID NO: 1630 - protein, 677 aa, Homo sapiens
MPGFLVRILPLLLVLLLLGPTRGLRNATQRMFEIDYSRDSFLKDGQPFRYISGSIHYSRVPRFYWKDRLLKMKMAGLNAIQTYVPWNFHEPWPGQYQFSEDHDVEYFLRLAHELGLLVILRPGPYICAEWEMGGLPAWLLEKESILLRSSDPDYLAAVDKWLGVLLPKMKPLLYQNGGPVITVQVENEYGSYFACDFDYLRFLQKRFRHHLGDDVVLFTTDGAHKTFLKCGALQGLYTTVDFGTGSNITDAFLSQRKCEPKGPLINSEFYTGWLDHWGQPHSTIKTEAVASSLYDILARGASVNLYMFIGGTNFAYWNGANSPYAAQPTSYDYDAPLSEAGDLTEKYFALRNIIQKFEKVPEGPIPPSTPKFAYGKVTLEKLKTVGAALDILCPSGPIKSLYPLTFIQVKQHYGFVLYRTTLPQDCSNPAPLSSPLNGVHDRAYVAVDGIPQGVLERNNVITLNITGKAGATLDLLVENMGRVNYGAYINDFKGLVSNLTLSSNILTDWTIFPLDTEDAVRSHLGGWGHRDSGHHDEAWAHNSSNYTLPAFYMGNFSIPSGIPDLPQDTFIQFPGWTKGQVWINGFNLGRYWPARGPQLTLFVPQHILMTSAPNTITVLELEWAPCSSDDPELCAVTFVDRPVIGSSVTYDHPSKPVEKRLMPPPPQKNKDSWLDHV

SEQ ID NO: 1631 - skipped

SEQ ID NO: 1632 - protein, 15 aa, Homo sapiens
TDDYLDQPCYETINR

SEQ ID NO: 1633 - protein, 445 aa, Homo sapiens
MNEEYDVIVLGTGLTECILSGIMSVNGKKVLHMDRNPYYGGESASITPLEDLYKRFKIPGSPPESMGRGRDWNVDLIPKFLMANGQLVKMLLYTEVTRYLDFKVTEGSFVYKGGKIYKVPSTEAEALASSLMGLFEKRRFRKFLVYVANFDEKDPRTFEGIDPKKTTMRDVYKKFDLGQDVIDFTGHALALYRTDDYLDQPCYETINRIKLYSESLARYGKSPYLYPLYGLGELPQGFARLSAIYGGTYMLNKPIEEIIVQNGKVIGVKSEGEIARCKQLICDPSYVKDRVEKVGQVIRVICILSHPIKNTNDANSCQIIIPQNQVNRKSDIYVCMISFAHNVAAQGKYIAIVSTTVETKEPEKEIRPALELLEPIEQKFVSISDLLVPKDLGTESQIFISRTYDATTHFETTCDDIKNIYKRMTGSEFDFEEMKRKKNDIYGED

SEQ ID NO: 1634 - protein, 12 aa, Homo sapiens
LLTSFLPAQLLR

SEQ ID NO: 1635 - protein, 14 aa, Homo sapiens
AVVTVPAYFNDSQR

SEQ ID NO: 1636 - protein, 10 aa, Homo sapiens
CNEIINWLDK

SEQ ID NO: 1637 - protein, 12 aa, Homo sapiens
DAGTIAGLNVLR

SEQ ID NO: 1638 - protein, 11 aa, Homo sapiens
FDDAVVQSDMK

SEQ ID NO: 1639 - protein, 10 aa, Homo sapiens
FEELNADLFR

SEQ ID NO: 1640 - protein, 11 aa, Homo sapiens
FELTGIPPAPR

SEQ ID NO: 1641 - protein, 9 aa, Homo sapiens
LLQDFFNGK

SEQ ID NO: 1642 - protein, 10 aa, Homo sapiens
MVNHFIAEFK

SEQ ID NO: 1643 - protein, 14 aa, Homo sapiens
NQTAEKEEFEHQQK

SEQ ID NO: 1644 - protein, 15 aa, Homo sapiens
NQVAMNPTNTVFDAK

SEQ ID NO: 1645 - protein, 24 aa, Homo sapiens
QTQTFTTYSDNQPGVLIQVYEGER

SEQ ID NO: 1646 - protein, 12 aa, Homo sapiens
RFDDAVVQSDMK

SEQ ID NO: 1647 - protein, 14 aa, Homo sapiens
SQIHDIVLVGGSTR

SEQ ID NO: 1648 - protein, 16 aa, Homo sapiens
STAGDTHLGGEDFDNR

SEQ ID NO: 1649 - protein, 18 aa, Homo sapiens
TVTNAVVTVPAYFNDSQR

SEQ ID NO: 1650 - protein, 10 aa, Homo sapiens
MVVNDAGRPK

SEQ ID NO: 1651 - protein, 6 aa, Homo sapiens
VQVEYK

SEQ ID NO: 1652 - protein, 14 aa, Homo sapiens
HWPFMVVNDAGRPK

SEQ ID NO: 1653 - protein, 646 aa, Homo sapiens
MSKGPAVGIDLGTTYSCVGVFQHGKVEIIANDQGNRTTPSYVAFTDTERLIGDAAKNQVAMNPTNTVFDAKRLIGRRFDDAVVQSDMKHWPFMVVNDAGRPKVQVEYKGETKSFYPEEVSSMVLTKMKEIAEAYLGKTVTNAVVTVPAYFNDSQRQATKDAGTIAGLNVLRIINEPTAAAIAYGLDKKVGAERNVLIFDLGGGTFDVSILTIEDGIFEVKSTAGDTHLGGEDFDNRMVNHFIAEFKRKHKKDISENKRAVRRLRTACERAKRTLSSSTQASIEIDSLYEGIDFYTSITRARFEELNADLFRGTLDPVEKALRDAKLDKSQIHDIVLVGGSTRIPKIQKLLQDFFNGKELNKSINPDEAVAYGAAVQAAILSGDKSENVQDLLLLDVTPLSLGIETAGGVMTVLIKRNTTIPTKQTQTFTTYSDNQPGVLIQVYEGERAMTKDNNLLGKFELTGIPPAPRGVPQIEVTFDIDANGILNVSAVDKSTGKENKITITNDKGRLSKEDIERMVQEAEKYKAEDEKQRDKVSSKNSLESYAFNMKATVEDEKLQGKINDEDKQKILDKCNEIINWLDKNQTAEKEEFEHQQKELEKVCNPIITKLYQSAGGMPGGMPGGFPGGGAPPSGGASSGPTIEEVD

SEQ ID NO: 1654 - protein, 14 aa, Homo sapiens
DATNVAAAFEEAVR

SEQ ID NO: 1655 - protein, 201 aa, Homo sapiens
MAGKSSLFKVILLGDGGVGKSSLMNRYVTNKFDTQLFHTIGVEFLNKDLEVDGHFVTMQIWDTAGQERFRSLRTPFYRGSDCCLLTFSVDDSQSFQNLSNWKKEFIYYADVKEPESFPFVILGNKIDISERQVSTEEAQAWCRDNGDYPYFETSAKDATNVAAAFEEAVRRVLATEDRSDHLIQTDTVNLHRKPKPSSSCC

SEQ ID NO: 1656 - protein, 15 aa, Homo sapiens
SLPVSDSVLSGFEQR

SEQ ID NO: 1657 - protein, 10 aa, Homo sapiens
ELAPLFEELR

SEQ ID NO: 1658 - protein, 16 aa, Homo sapiens
KLPSVEGLHAIVVSDR

SEQ ID NO: 1659 - protein, 124 aa, Homo sapiens
MADDLKRFLYKKLPSVEGLHAIVVSDRDGVPVIKVANDNAPEHALRPGFLSTFALATDQGSKLGLSKNKSIICYYNTYQVVQFNRLPLVVSFIASSSANTGLIVSLEKELAPLFEELRQVVEVS

SEQ ID NO: 1660 - protein, 12 aa, Homo sapiens
LDNLVAILDINR

SEQ ID NO: 1661 - protein, 24 aa, Homo sapiens
LLQEGQALEYVCPSGFYPYPVQTR

SEQ ID NO: 1662 - protein, 14 aa, Homo sapiens
VCPSGFYPYPVQTR

SEQ ID NO: 1663 - protein, 764 aa, Homo sapiens
MGSNLSPQLCLMPFILGLLSGGVTTTPWSLARPQGSCSLEGVEIKGGSFRLLQEGQALEYVCPSGFYPYPVQTRTCRSTGSWSTLKTQDQKTVRKAECRAIHCPRPHDFENGEYWPRSPYYNVSDEISFHCYDGYTLRGSANRTCQVNGRWSGQTAICDNGAGYCSNPGIPIGTRKVGSQYRLEDSVTYHCSRGLTLRGSQRRTCQEGGSWSGTEPSCQDSFMYDTPQEVAEAFLSSLTETIEGVDAEDGHGPGEQQKRKIVLDPSGSMNIYLVLDGSDSIGASNFTGAKKCLVNLIEKVASYGVKPRYGLVTYATYPKIWVKVSEADSSNADWVTKQLNEINYEDHKLKSGTNTKKALQAVYSMMSWPDDVPPEGWNRTRHVIILMTDGLHNMGGDPITVIDEIRDLLYIGKDRKNPREDYLDVYVFGVGPLVNQVNINALASKKDNEQHVFKVKDMENLEDVFYQMIDESQSLSLCGMVWEHRKGTDYHKQPWQAKISVIRPSKGHESCMGAVVSEYFVLTAAHCFTVDDKEHSIKVSVGGEKRDLEIEVVLFHPNYNINGKKEAGIPEFYDYDVALIKLKNKLKYGQTIRPICLPCTEGTTRALRLPPTTTCQQQKEELLPAQDIKALFVSEEEKKLTRKEVYIKNGDKKGSCERDAQYAPGYDKVKDISEVVTPRFLCTGGVSPYADPNTCRGDSGGPLIVHKRSRFIQVGVISWGVVDVCKNQKRQKQVPAHARDFHINLFQVLPWLKEKLQDEDLGFL

SEQ ID NO: 1664 - protein, 22 aa, Homo sapiens
AQNLPQSPENTDLQVIPGSQTR

SEQ ID NO: 1665 - protein, 23 aa, Homo sapiens
DTASDSPAGIDNPVFSPDEALDR

SEQ ID NO: 1666 - protein, 30 aa, Homo sapiens
AEVQEVVWGEGAGAGEPEAEEEGDFVNSGR

SEQ ID NO: 1667 - protein, 10 aa, Homo sapiens
YLALLETLTR

SEQ ID NO: 1668 - protein, 914 aa, Homo sapiens
MASESSPLLAYRLLGEEGVALPANGAGGPGGASARKLSTFLGVVVPTVLSMFSIVVFLRIGFVVGHAGLLQALAMLLVAYFILALTVLSVCAIATNGAVQGGGAYFMISRTLGPEVGGSIGLMFYLANVCGCAVSLLGLVESVLDVFGADATGPSGLRVLPQGYGWNLLYGSLLLGLVGGVCTLGAGLYARASFLTFLLVSGSLASVLISFVAVGPRDIRLTPRPGPNGSSLPPRFGHFTGFNSSTLKDNLGAGYAEDYTTGAVMNFASVFAVLFNGCTGIMAGANMSGELKDPSRAIPLGTIVAVAYTFFVYVLLFFLSSFTCDRTLLQEDYGFFRAISLWPPLVLIGIYATALSASMSSLIGASRILHALARDDLFGVILAPAKVVSRGGNPWAAVLYSWGLVQLVLLAGKLNTLAAVVTVFYLVAYAAVDLSCLSLEWASAPNFRPTFSLFSWHTCLLGVASCLLMMFLISPGAAGGSLLLMGLLAALLTARGGPSSWGYVSQALLFHQVRKYLLRLDVRKDHVKFWRPQLLLLVGNPRGALPLLRLANQLKKGGLYVLGHVTLGDLDSLPSDPVQPQYGAWLSLVDRAQVKAFVDLTLSPSVRQGAQHLLRISGLGGMKPNTLVLGFYDDAPPQDHFLTDPAFSEPADSTREGSSPALSTLFPPPRAPGSPRALNPQDYVATVADALKMNKNVVLARASGALPPERLSRGSGGTSQLHHVDVWPLNLLRPRGGPGYVDVCGLFLLQMATILGMVPAWHSARLRIFLCLGPREAPGAAEGRLRALLSQLRIRAEVQEVVWGEGAGAGEPEAEEEGDFVNSGRGDAEAEALARSANALVRAQQGRGTGGGPGGPEGGDAEGPITALTFLYLPRPPADPARYPRYLALLETLTRDLGPTLLVHGVTPVTCTDL

SEQ ID NO: 1669 - protein, 11 aa, Homo sapiens
FEIWDTAGQER

SEQ ID NO: 1670 - protein, 20 aa, Homo sapiens
GVNLPGAQVDLPGLSEQDVR

SEQ ID NO: 1671 - protein, 574 aa, Homo sapiens
MSIQENISSLQLRSWVSKSQRDLAKSILIGAPGGPAGYLRRASVAQLTQELGTAFFQQQQLPAAMADTFLEHLCLLDIDSEPVAARSTSIIATIGPASRSVERLKEMIKAGMNIARLNFSHGSHEYHAESIANVREAVESFAGSPLSYRPVAIALDTKGPEIRTGILQGGPESEVELVKGSQVLVTVDPAFRTRGNANTVWVDYPNIVRVVPVGGRIYIDDGLISLVVQKIGPEGLVTQVENGGVLGSRKGVNLPGAQVDLPGLSEQDVRDLRFGVEHGVDIVFASFVRKASDVAAVRAALGPEGHGIKIISKIENHEGVKRFDEILEVSDGIMVARGDLGIEIPAEKVFLAQKMMIGRCNLAGKPVVCATQMLESMITKPRPTRAETSDVANAVLDGADCIMLSGETAKGNFPVEAVKMQHAIAREAEAAVYHRQLFEELRRAAPLSRDPTEVTAIGAVEAAFKCCAAAIIVLTTTGRSAQLLSRYRPRAAVIAVTRSAQAARQVHLCRGVFPLLYREPPEAIWADDVDRRVQFGIESGKLRGFLRVGDLVIVVTGWRPGSGYTNIMRVLSIS

SEQ ID NO: 1672 - protein, 19 aa, Homo sapiens
DQQEAALVDMVNDGVEDLR

SEQ ID NO: 1673 - protein, 16 aa, Homo sapiens
FQDGDLTLYQSNTILR

SEQ ID NO: 1674 - protein, 8 aa, Homo sapiens
TVVYFPVR

SEQ ID NO: 1675 - protein, 210 aa, Homo sapiens
MPPYTVVYFPVRGRCAALRMLLADQGQSWKEEVVTVETWQEGSLKASCLYGQLPKFQDGDLTLYQSNTILRHLGRTLGLYGKDQQEAALVDMVNDGVEDLRCKYISLIYTNYEAGKDDYVKALPGQLKPFETLLSQNQGGKTFIVGDQISFADYNLLDLLLIHEVLAPGCLDAFPLLSAYVGRLSARPKLKAFLASPEYVNLPINGNGKQ

SEQ ID NO: 1676 - protein, 10 aa, Homo sapiens
FTMVQVWPVR

SEQ ID NO: 1677 - protein, 9 aa, Homo sapiens
HFTEFVPLR

SEQ ID NO: 1678 - protein, 15 aa, Homo sapiens
SDYAQLLEDMQNAFR

SEQ ID NO: 1679 - protein, 12 aa, Homo sapiens
LPANHPLLTGQR

SEQ ID NO: 1680 - protein, 18 aa, Homo sapiens
EILQEEEDLAEIVQLVGK

SEQ ID NO: 1681 - protein, 617 aa, Homo sapiens
MDFSKLPKILDEDKESTFGYVHGVSGPVVTACDMAGAAMYELVRVGHSELVGEIIRLEGDMATIQVYEETSGVSVGDPVLRTGKPLSVELGPGIMGAIFDGIQRPLSDISSQTQSIYIPRGVNVSALSRDIKWDFTPCKNLRVGSHITGGDIYGIVSENSLIKHKIMLPPRNRGTVTYIAPPGNYDTSDVVLELEFEGVKEKFTMVQVWPVRQVRPVTEKLPANHPLLTGQRVLDALFPCVQGGTTAIPGAFGCGKTVISQSLSKYSNSDVIIYVGCGERGNEMSEVLRDFPELTMEVDGKVESIMKRTALVANTSNMPVAAREASIYTGITLSEYFRDMGYHVSMMADSTSRWAEALREISGRLAEMPADSGYPAYLGARLASFYERAGRVKCLGNPEREGSVSIVGAVSPPGGDFSDPVTSATLGIVQVFWGLDKKLAQRKHFPSVNWLISYSKYMRALDEYYDKHFTEFVPLRTKAKEILQEEEDLAEIVQLVGKASLAETDKITLEVAKLIKDDFLQQNGYTPYDRFCPFYKTVGMLSNMIAFYDMARRAVETTAQSDNKITWSIIREHMGDILYKLSSMKFKDPLKDGEAKIKSDYAQLLEDMQNAFRSLED

SEQ ID NO: 1682 - protein, 19 aa, Homo sapiens
NVVHQLSVTLEDLYNGATR

SEQ ID NO: 1683 - protein, 397 aa, Homo sapiens
MVKETTYYDVLGVKPNATQEELKKAYRKLALKYHPDKNPNEGEKFKQISQAYEVLSDAKKRELYDKGGEQAIKEGGAGGGFGSPMDIFDMFFGGGGRMQRERRGKNVVHQLSVTLEDLYNGATRKLALQKNVICDKCEGRGGKKGAVECCPNCRGTGMQIRIHQIGPGMVQQIQSVCMECQGHGERISPKDRCKSCNGRKIVREKKILEVHIDKGMKDGQKITFHGEGDQEPGLEPGDIIIVLDQKDHAVFTRRGEDLFMCMDIQLVEALCGFQKPISTLDNRTIVITSHPGQIVKHGDIKCVLNEGMPIYRRPYEKGRLIIEFKVNFPENGFLSPDKLSLLEKLLPERKEVEETDEMDQVELVDFDPNQERRRHYNGEAYEDDEHHPRGGVQCQTS

SEQ ID NO: 1684 - protein, 13 aa, Homo sapiens
QSVELHSPQSLPR

SEQ ID NO: 1685 - protein, 11 aa, Homo sapiens
GLEPDTDWEER

SEQ ID NO: 1686 - protein, 271 aa, Homo sapiens
MWELRSIAFSRAVFAEFLATLLFVFFGLGSALNWPQALPSVLQIAMAFGLGIGTLVQALGHISGAHINPAVTVACLVGCHVSVLRAAFYVAAQLLGAVAGAALLHEITPADIRGDLAVNALSNSTTAGQAVTVELFLTLQLVLCIFASTDERRGENPGTPALSIGFSVALGHLLGIHYTGCSMNPARSLAPAVVTGKFDDHWVFWIGPLVGAILGSLLYNYVLFPPAKSLSERLAVLKGLEPDTDWEEREVRRRQSVELHSPQSLPRGTKA

SEQ ID NO: 1687 - protein, 17 aa, Homo sapiens
LTLTSDESTLIEDGGAR

SEQ ID NO: 1688 - protein, 453 aa, Homo sapiens
MGSVLGLCSMASWIPCLCGSAPCLLCRCCPSGNNSTVTRLIYALFLLVGVCVACVMLIPGMEEQLNKIPGFCENEKGVVPCNILVGYKAVYRLCFGLAMFYLLLSLLMIKVKSSSDPRAAVHNGFWFFKFAAAIAIIIGAFFIPEGTFTTVWFYVGMAGAFCFILIQLVLLIDFAHSWNESWVEKMEEGNSRCWYAALLSATALNYLLSLVAIVLFFVYYTHPASCSENKAFISVNMLLCVGASVMSILPKIQESQPRSGLLQSSVITVYTMYLTWSAMTNEPETNCNPSLLSIIGYNTTSTVPKEGQSVQWWHAQGIIGLILFLLCVFYSSIRTSNNSQVNKLTLTSDESTLIEDGGARSDGSLEDGDDVHRAVDNERDGVTYSYSFFHFMLFLASLYIMMTLTNWYRYEPSREMKSQWTAVWVKISSSWIGIVLYVWTLVAPLVLTNRDFD

SEQ ID NO: 1689 - protein, 13 aa, Homo sapiens
EFGSLPTTPSEQR

SEQ ID NO: 1690 - protein, 26 aa, Homo sapiens
NLVSWESQTQPQVQVQDEEITEDDLR

SEQ ID NO: 1691 - protein, 14 aa, Homo sapiens
QLEADIMDINEIFK

SEQ ID NO: 1692 - protein, 15 aa, Homo sapiens
TLNQLGTPQDSPELR

SEQ ID NO: 1693 - protein, 18 aa, Homo sapiens
GQEAFVPGFNIEELLPER

SEQ ID NO: 1694 - protein, 17 aa, Homo sapiens
FHYLPFLPSTEDVYDCR

SEQ ID NO: 1695 - protein, 17 aa, Homo sapiens
NGKPVTTGVSETVFLPR

SEQ ID NO: 1696 - protein, 12 aa, Homo sapiens
VEHWGLDEPLLK

SEQ ID NO: 1697 - protein, 18 aa, Homo sapiens
KFHYLPFLPSTEDVYDCR

SEQ ID NO: 1698 - protein, 6 aa, Homo sapiens
EDHLFR

SEQ ID NO: 1699 - protein, 254 aa, Homo sapiens
MAISGVPVLGFFIIAVLMSAQESWAIKEEHVIIQAEFYLNPDQSGEFMFDFDGDEIFHVDMAKKETVWRLEEFGRFASFEAQGALANIAVDKANLEIMTKRSNYTPITNVPPEVTVLTNSPVELREPNVLICFIDKFTPPVVNVTWLRNGKPVTTGVSETVFLPREDHLFRKFHYLPFLPSTEDVYDCRVEHWGLDEPLLKHWEFDAPSPLPETTENVVCALGLTVGLVGIIIGTIFIIKGLRKSNAAERRGPL

SEQ ID NO: 1700 - protein, 8 aa, Homo sapiens
IFHVNWFR

SEQ ID NO: 1701 - protein, 12 aa, Homo sapiens
LLGQMEEEGILR

SEQ ID NO: 1702 - protein, 11 aa, Homo sapiens
FLWPGFGENSR

SEQ ID NO: 1703 - protein, 12 aa, Homo sapiens
FLVGPDGIPIMR

SEQ ID NO: 1704 - protein, 6 aa, Homo sapiens
FYTFLK

SEQ ID NO: 1705 - protein, 14 aa, Homo sapiens
QEPGENSEILPTLK

SEQ ID NO: 1706 - protein, 17 aa, Homo sapiens
YVRPGGGFVPNFQLFEK

SEQ ID NO: 1707 - protein, 225 aa, Homo sapiens
MARLLQASCLLSLLLAGFVSQSRGQEKSKMDCHGGISGTIYEYGALTIDGEEYIPFKQYAGKYVLFVNVASYGLTGQYIELNALQEELAPFGLVILGFPCNQFGKQEPGENSEILPTLKYVRPGGGFVPNFQLFEKGDVNGEKEQKFYTFLKNSCPPTSELLGTSDRLFWEPMKVHDIRWNFEKFLVGPDGIPIMRWHHRTTVSNVKMDILSYMRRQAALGVKRK

SEQ ID NO: 1708 - protein, 11 aa, Homo sapiens
GRPFFPPHPYK

SEQ ID NO: 1709 - protein, 22 aa, Homo sapiens
LQYDVYQYFLPENDLTEEMLLK

SEQ ID NO: 1710 - protein, 16 aa, Homo sapiens
QYFLPENDLTEEMLLK

SEQ ID NO: 1711 - protein, 15 aa, Homo sapiens
VTNILDPSYHIPPLR

SEQ ID NO: 1712 - protein, 570 aa, Homo sapiens
MGFLQLLVVAVLASEHRVAGAAEVFGNSSEGLIEFSVGKFRYFELNRPFPEEAILHDISSNVTFLIFQIHSQYQNTTVSFSPTLLSNSSETGTASGLVFILRPEQSTCTWYLGTSGIQPVQNMAILLSYSERDPVPGGCNLEFDLDIDPNIYLEYNFFETTIKFAPANLGYARGVDPPPCDAGTDQDSRWRLQYDVYQYFLPENDLTEEMLLKHLQRMVSVPQVKASALKVVTLTANDKTSVSFSSLPGQGVIYNVIVWDPFLNTSAAYIPAHTYACSFEAGEGSCASLGRVSSKVFFTLFALLGFFICFFGHRFWKTELFFIGFIIMGFFFYILITRLTPIKYDVNLILTAVTGSVGGMFLVAVWWRFGILSICMLCVGLVLGFLISSVTFFTPLGNLKIFHDDGVFWVTFSCIAILIPVVFMGCLRILNILTCGVIGSYSVVLAIDSYWSTSLSYITLNVLKRALNKDFHRAFTNVPFQTNDFIILAVWGMLAVSGITLQIRRERGRPFFPPHPYKLWKQERERRVTNILDPSYHIPPLRERLYGRLTQIKGLFQKEQPAGERTPLLL

SEQ ID NO: 1713 - protein, 9 aa, Homo sapiens
FALLGDFFR

SEQ ID NO: 1714 - protein, 170 aa, Homo sapiens
MKTQRDGHSLGRWSLVLLLLGLVMPLAIIAQVLSYKEAVLRAIDGINQRSSDANLYRLLDLDPRPTMDGDPDTPKPVSFTVKETVCPRTTQQSPEDCDFKKDGLVKRCMGTVTLNQARGSFDISCDKDNKRFALLGDFFRKSKEKIGKEFKRIVQRIKDFLRNLVPRTES

SEQ ID NO: 1715 - protein, 11 aa, Homo sapiens
NTFLWTEFTDR

SEQ ID NO: 1716 - protein, 22 aa, Homo sapiens
IINLGPVHPGPLSPEPQPMGVR

SEQ ID NO: 1717 - protein, 19 aa, Homo sapiens
VILQDFTGVPAVVDFAAMR

SEQ ID NO: 1718 - protein, 889 aa, Homo sapiens
MSNPFAHLAEPLDPVQPGKKFFNLNKLEDSRYGRLPFSIRVLLEAAIRNCDEFLVKKQDIENILHWNVTQHKNIEVPFKPARVILQDFTGVPAVVDFAAMRDAVKKLGGDPEKINPVCPADLVIDHSIQVDFNRRADSLQKNQDLEFERNRERFEFLKWGSQAFHNMRIIPPGSGIIHQVNLEYLARVVFDQDGYYYPDSLVGTDSHTTMIDGLGILGWGVGGIEAEAVMLGQPISMVLPQVIGYRLMGKPHPLVTSTDIVLTITKHLRQVGVVGKFVEFFGPGVAQLSIADRATIANMCPEYGATAAFFPVDEVSITYLVQTGRDEEKLKYIKKYLQAVGMFRDFNDPSQDPDFTQVVELDLKTVVPCCSGPKRPQDKVAVSDMKKDFESCLGAKQGFKGFQVAPEHHNDHKTFIYDNTEFTLAHGSVVIAAITSCTNTSNPSVMLGAGLLAKKAVDAGLNVMPYIKTSLSPGSGVVTYYLQESGVMPYLSQLGFDVVGYGCMTCIGNSGPLPEPVVEAITQGDLVAVGVLSGNRNFEGRVHPNTRANYLASPPLVIAYAIAGTIRIDFEKEPLGVNAKGQQVFLKDIWPTRDEIQAVERQYVIPGMFKEVYQKIETVNESWNALATPSDKLFFWNSKSTYIKSPPFFENLTLDLQPPKSIVDAYVLLNLGDSVTTDHISPAGNIARNSPAARYLTNRGLTPREFNSYGSRRGNDAVMARGTFANIRLLNRFLNKQAPQTIHLPSGEILDVFDAAERYQQAGLPLIVLAGKEYGAGSSRDWAAKGPFLLGIKAVLAESYERIHRSNLVGMGVIPLEYLPGENADALGLTGQERYTIIIPENLKPQMKVQVKLDTGKTFQAVMRFDTDVELTYFLNGGILNYMIRKMAK

SEQ ID NO: 1719 - protein, 22 aa, Homo sapiens
GKFPVQLENVDSFVELGQVALR

SEQ ID NO: 1720 - protein, 20 aa, Homo sapiens
FPVQLENVDSFVELGQVALR

SEQ ID NO: 1721 - protein, 709 aa, Homo sapiens
MATAGGGSGADPGSRGLLRLLSFCVLLAGLCRGNSVERKIYIPLNKTAPCVRLLNATHQIGCQSSISGDTGVIHVVEKEEDLQWVLTDGPNPPYMVLLESKHFTRDLMEKLKGRTSRIAGLAVSLTKPSPASGFSPSVQCPNDGFGVYSNSYGPEFAHCREIQWNSLGNGLAYEDFSFPIFLLEDENETKVIKQCYQDHNLSQNGSAPTFPLCAMQLFSHMHAVISTATCMRRSSIQSTFSINPEIVCDPLSDYNVWSMLKPINTTGTLKPDDRVVVAATRLDSRSFFWNVAPGAESAVASFVTQLAAAEALQKAPDVTTLPRNVMFVFFQGETFDYIGSSRMVYDMEKGKFPVQLENVDSFVELGQVALRTSLELWMHTDPVSQKNESVRNQVEDLLATLEKSGAGVPAVILRRPNQSQPLPPSSLQRFLRARNISGVVLADHSGAFHNKYYQSIYDTAENINVSYPEWLSPEEDLNFVTDTAKALADVATVLGRALYELAGGTNFSDTVQADPQTVTRLLYGFLIKANNSWFQSILRQDLRSYLGDGPLQHYIAVSSPTNTTYVVQYALANLTGTVVNLTREQCQDPSKVPSENKDLYEYSWVQGPLHSNETDRLPRCVRSTARLARALSPAFELSQWSSTEYSTWTESRWKDIRARIFLIASKELELITLTVGFGILIFSLIVTYCINAKADVLFIAPREPGAVSY

SEQ ID NO: 1722 - protein, 17 aa, Homo sapiens
AVIVIQDIFGWQLPNTR

SEQ ID NO: 1723 - protein, 8 aa, Homo sapiens
EVQVEHIK

SEQ ID NO: 1724 - protein, 8 aa, Homo sapiens
NLIEWLNK

SEQ ID NO: 1725 - protein, 8 aa, Homo sapiens
NLIEWLNK

SEQ ID NO: 1726 - protein, 13 aa, Homo sapiens
SVSGFYPGSIEVR

SEQ ID NO: 1727 - protein, 25 aa, Homo sapiens
TQPLQHHNLLVCSVSGFYPGSIEVR

SEQ ID NO: 1728 - protein, 266 aa, Homo sapiens
MVCLKLPGGSSLAALTVTLMVLSSRLAFAGDTRPRFLELRKSECHFFNGTERVRYLDRYFHNQEEFLRFDSDVGEYRAVTELGRPVAESWNSQKDLLEQKRGRVDNYCRHNYGVGESFTVQRRVHPQVTVYPAKTQPLQHHNLLVCSVSGFYPGSIEVRWFRNGQEEKAGVVSTGLIQNGDWTFQTLVMLETVPRSGEVYTCQVEHPSVTSALTVEWRARSESAQSKMLSGVGGFVLGLLFLGAGLFIYFRNQKGHSGLQPTGFLS

SEQ ID NO: 1729 - protein, 19 aa, Homo sapiens
INNVPAEGENEVNNELANR

SEQ ID NO: 1730 - protein, 13 aa, Homo sapiens
DAEGILEDLQSYR

SEQ ID NO: 1731 - protein, 316 aa, Homo sapiens
MGNLLKVLTCTDLEQGPNFFLDFENAQPTESEKEIYNQVNVVLKDAEGILEDLQSYRGAGHEIREAIQHPADEKLQEKAWGAVVPLVGKLKKFYEFSQRLEAALRGLLGALTSTPYSPTQHLEREQALAKQFAEILHFTLRFDELKMTNPAIQNDFSYYRRTLSRMRINNVPAEGENEVNNELANRMSLFYAEATPMLKTLSDATTKFVSENKNLPIENTTDCLSTMASVCRVMLETPEYRSRFTNEETVSFCLRVMVGVIILYDHVHPVGAFAKTSKIDMKGCIKVLKDQPPNSVEGLLNALRYTTKHLNDETTS

We claim:

1. A method of treating, comprising:
   a) collecting at least one urine sample from a patient within fourteen days of exhibiting an acute renal injury, wherein said patient is asymptomatic of a renal disease;
   b) expressing a plurality of renal injury protein biomarker nucleic acids from said at least one urine sample with a proteomics platform to create a signature expression profile, said profile comprising a renal injury protein biomarker panel;
   c) detecting a plurality of overexpressed renal injury protein biomarkers and a plurality of underexpressed renal injury protein biomarkers from said renal injury biomarker panel when compared to a renal recovery group comprising individuals without an acute renal injury,
   wherein said plurality of overexpressed renal injury protein biomarkers are selected from the group consisting of ferritin, beta globin, catalase, alpha globin, epidermal growth factor receptor pathway substrate 8, mucin isoform precursor, ezrin, delta globin, moesin, phosphoprotein isoform and annexin A2, and
   wherein said underexpressed renal injury protein biomarkers are selected from the group consisting of myoglobin, hemopexin, serine proteinase inhibitor, serpine peptidase inhibitor, CD14 antigen precursor, fibronectin isoform preprotein, angiotensinogen preprotein, complement component precursor, carbonic anhydrase, uromodulin precursor, complement factor H, complement component 4 BP, olfactomedian-4, leucine rich alpha-2 glycoprotein, ring finger protein 167, inter-alpha globulin inhibitor H4, heparan sulfate proteoglycan 2, N-acylshingosine aminohydrolase, serine proteinase inhibitor clade A member 1, mucin 1, clusterin isoform 1, brain abundant membrane attached signal protein 1, dipeptidase 1, fibronectin 1 isoform 5 preprotein, angiotensinogen preproprotien, and uromodulin precursor;
   d) creating a probability value of non-recovery for said patient from said acute renal injury by a combination of receiver operated characteristic area under the curve determinations for said plurality of detected overexpressed renal injury biomarkers and said plurality of detected underexpressed renal injury biomarkers as compared to a plurality of diagnostic threshold values, wherein said acute renal injury recovery is determined by an improved renal function;
   e) treating said patient during the development of said renal disease with a treatment regimen selected from the group consisting of: i) said treatment regimen comprising adverse effects when said probability value of non-recovery from said acute renal injury is greater than 50%, and ii) said treatment regimen without adverse effects when said probability value of non-recovery from said acute renal injury is less than 50%.

2. The method of claim 1, wherein said probability value of non-recovery from said acute renal injury is less than 25%.

3. The method of claim 1, wherein said treatment regimen is selected from the group consisting of initiating renal replacement therapy, withdrawing kidney damaging compounds, kidney transplantation, delaying or avoiding kidney damaging procedures and modifying diuretic administration.

4. The method of claim 1, wherein said plurality of overexpressed renal injury biomarkers are between approximately 1.5 fold-2.5 fold higher in comparison to an expected value from said renal recovery group.

5. The method of claim 1, wherein said plurality of underexpressed renal injury biomarkers are between approximately 1.5 fold and 2.0 fold lower in comparison to an expected value from a renal recovery group.

6. The method of claim 1, wherein said probability value of non-recovery from said acute renal injury is less than 10%.

7. The method of claim 1, wherein said probability value of non-recovery from said acute renal injury is greater than 75%.

8. The method of claim 1, wherein said probability value of non-recovery from said acute renal injury is greater than 90%.

* * * * *